United States Patent 8,664,475 (PLANTS WITH INCREASED YIELD) - sequence listing, part 6

SEQ ID NO: 13676 - DNA, 1242 bp, Ralstonia solanacearum GMI1000
  CDS (1)..(1242): transl_table=11
atggccgacgacctgaatccgcgcctcgcgcaggcccacacgcccgaatcccgcgcgctgaacgttcccgacgcgatcctgcccgacagctggctgggcatgctcggcggcggccagctcggccgcatgttcacgcacgccgcacaggcgatgggctacaaggtgtgcgtgctggaccccgacccgaacagccccgccggcaccgtcgccgagcgccacctgtgcgcggcctacacggatgaggccgcgctggccgagctggccgcgctgtgcccggcggtcaccaccgaattcgagaacgtgccggcacaggcgctcgaccgcctcgagcacctcggcgccttcgtcgcgccgcgcgcccactgcgtgtcgatcgcgcagaaccgcatcgccgagaagaaattctttgcgctgtgcgccgcccgcaccggcatccacccggcgccgagctgggtgatcgagcacgacgccgacatcgaccagctgccggccgacctgctgcccggcatcctgaagatcgcccgcatgggctacgacggcaagggccaggcgcgcgtctccacggtcggcgagctgcgcgcggcctggggcgcgatgcagcacgtgccgtgcgtgctggagaagatgctgccgctggcctacgaagtgtccgtgctggccgcccgcgccgccgacggcagcaccgttacctggccgctggccgagaacattcaccgcgacggcatcctgttctccacggtcatgccctcgcgcagcgtgtcggacgacatcgccacgcgcacccgcgccgccgccgcaatgatcaccgaggagatgggctacgtgggcgtgctgtgcatcgagttcttcgtgctgcaggacggttcgctgatcgccaacgagatggcgccgcgcccgcacaactcgggccatatcactatggatgtgtgcgagaccagccagttcgagcagcaggtgcgtaccatggcccgcctgccgctgggcagcacgcgccagcattcgccggggcgcatgctcaacgtgctgggcgacgtgtggttcgagtacggcctggaacgcacgcccgcgtggcacgatgtgatgcggcattccggcaccaaggtgcacctgtacggcaaggccgacgcgcgtccgggccgcaagatgggccatgtcaattgcgtcggcacgtcgcccgaggtggcggacgaggcgttccaccatgccgtgcaggtgctcggcctgcaatcggccccggcctga

SEQ ID NO: 13677 - protein, 413 aa, Ralstonia solanacearum GMI1000
MADDLNPRLAQAHTPESRALNVPDAILPDSWLGMLGGGQLGRMFTHAAQAMGYKVCVLDPDPNSPAGTVAERHLCAAYTDEAALAELAALCPAVTTEFENVPAQALDRLEHLGAFVAPRAHCVSIAQNRIAEKKFFALCAARTGIHPAPSWVIEHDADIDQLPADLLPGILKIARMGYDGKGQARVSTVGELRAAWGAMQHVPCVLEKMLPLAYEVSVLAARAADGSTVTWPLAENIHRDGILFSTVMPSRSVSDDIATRTRAAAAMITEEMGYVGVLCIEFFVLQDGSLIANEMAPRPHNSGHITMDVCETSQFEQQVRTMARLPLGSTRQHSPGRMLNVLGDVWFEYGLERTPAWHDVMRHSGTKVHLYGKADARPGRKMGHVNCVGTSPEVADEAFHHAVQVLGLQSAPA

SEQ ID NO: 13678 - DNA, 1077 bp, Agrobacterium tumefaciens str. C58
  CDS (1)..(1077): transl_table=11
atggcaaagacgaataacctgaccatcggcatcatcggcggcgggcagcttggccggatgctggccatggcagcggcccgcctcaaccaccgcaccatcgtgctggagccgcaggccgattgtccggccgcgcaggtttgcaatgaccagatcgttgcggaatatgacgacgaaaaggcgcttgccgaactcgcaagccgctgcgatgtcgtgacctacgaattcgaaaacgtgcctgtcgcagccgccgaaaaactcagcgcctccgtgcccgtctacccgccggcgcaggcgctcagcgcctcgcaggaccgcttgacggaaaaacgcttcctcaatggttgcggcattccgaccgccgattttcgcgccgtggatagccaggacgagctggaagctgccttgaccgcctttggcggcaagggtgtgctgaaaacccgccgtatgggttatgacggcaagggccagcgtctcttccggggcggcgaaaacctcacaggcgcctttgcggcgctcggcggcgtgccgctgatcctcgaaagtttcgtcgccttcgagcgggaaatttcgatcatcgccgcccgtttccaggacggtaccgtcacctgttacgatccggccgaaaacgtccatctgaacggcattctgcacacatcgacggtgccggcagcactttccgatgccgcaaaggctgtcgccgtgcaatcggccgaaaagcttctcgccgcgctcgagtatgtcggcgtcatcggtattgaatttttcgtcctgccggatggttctctggttgccaatgaaatggcgccgcgtgtccacaataccggccactggacggaagcggcttgtgcgatctcgcagttcgagcagcatatccgggccgtgtcggaccttgcccctggcagcacggatcgccattccgattgtgtgatgaccaatctgatcggcgacgacatcaacgacgtgcccgcatggctgtcgaaaaaagactgtctcgtgcatctctatggcaagacggaagcaaggcctggccgcaagatgggccatgtgaccgagcttctgcacacaggaaaggcctag

SEQ ID NO: 13679 - protein, 358 aa, Agrobacterium tumefaciens str. C58
MAKTNNLTIGIIGGGQLGRMLAMAAARLNHRTIVLEPQADCPAAQVCNDQIVAEYDDEKALAELASRCDVVTYEFENVPVAAAEKLSASVPVYPPAQALSASQDRLTEKRFLNGCGIPTADFRAVDSQDELEAALTAFGGKGVLKTRRMGYDGKGQRLFRGGENLTGAFAALGGVPLILESFVAFEREISIIAARFQDGTVTCYDPAENVHLNGILHTSTVPAALSDAAKAVAVQSAEKLLAALEYVGVIGIEFFVLPDGSLVANEMAPRVHNTGHWTEAACAISQFEQHIRAVSDLAPGSTDRHSDCVMTNLIGDDINDVPAWLSKKDCLVHLYGKTEARPGRKMGHVTELLHTGKA

SEQ ID NO: 13680 - DNA, 1119 bp, Pyrococcus furiosus DSM 3638
  CDS (1)..(1119): transl_table=11
atgatagtgggaattcttggagggggtcaattagctaagatgatggctcaggaagccaagaaaatgggctttaaagtagctatccttgatcctcaagaagaacctccagctaaaggagtttccgattatcatattctaggtagctttaaagacgagaaagctataagaaaattagcagagatatctgatgttctaacgtacgatatagagcacataaatgttcaagctctaaaagagcttgagaaggaaggtgtgcaaatatatccatcacctagggttctggaaataattcaggataaactagtacaaatgcaggttatgaaggaggctggaattcctgtcccacgctttataaaagcagataaagacgagttggttgacaaggccttagaatttggatttcctttagttcaaaagactagaagagaaggatatgatggaaaaggagtagcagttataagagacaaaagtgagctagctaaattgattcctgcagactcaatgcttcaggagttcgtaaacatagaaaaagagattgccgtaatggtggctagagatcaggaggggaatactgtagcatatcctgttgttgagatgacgtttaacgaggcaaatatactcgatatgctcattgcacccgcaaggattgaggaggaaatagctgaagaagcaaagagaattgcaataaaggctgtaaaagctttagatggggtgggaatatttggagtagagatgtttctgacaaaagatggggaggtgtatcttaacgaaatagctccaaggccccataattcaggtcattacactatagaggcttgcctaacaagccagtttgaacagcatataagagctataacaggtctcccgctgggaagttctgagcttttaattcccgcggtaatgtttaacctccttggagaaggaaacgggaagccaaaggttattggaatgaaggaagctcttaaattcccaggagtgtatgtccatatttatggaaagtccgttgttaagcctctaagaaagatgggtcatgtaaccgtcgtaaatagaaatttggaaaaggccttagagattgcccacaaagttaagaaggtaataaaggtggttggagatgcctaa

SEQ ID NO: 13681 - protein, 372 aa, Pyrococcus furiosus DSM 3638
MIVGILGGGQLAKMMAQEAKKMGFKVAILDPQEEPPAKGVSDYHILGSFKDEKAIRKLAEISDVLTYDIEHINVQALKELEKEGVQIYPSPRVLEIIQDKLVQMQVMKEAGIPVPRFIKADKDELVDKALEFGFPLVQKTRREGYDGKGVAVIRDKSELAKLIPADSMLQEFVNIEKEIAVMVARDQEGNTVAYPVVEMTFNEANILDMLIAPARIEEEIAEEAKRIAIKAVKALDGVGIFGVEMFLTKDGEVYLNEIAPRPHNSGHYTIEACLTSQFEQHIRAITGLPLGSSELLIPAVMFNLLGEGNGKPKVIGMKEALKFPGVYVHIYGKSVVKPLRKMGHVTVVNRNLEKALEIAHKVKKVIKVVGDA

SEQ ID NO: 13682 - DNA, 1164 bp, Corynebacterium glutamicum ATCC 13032
  CDS (1)..(1164): transl_table=11
atgcccatcgtcgcagtaattggtgacggccaattagcccgcatgatgcagacctccgccatcgaactcggacaatcactgcgagttctagctggagcgccggattcctccgcagctcaagtagctgctgatgttgttctcggcgattacaccaacattgatgatctgcgcgtcgccatcgaaggcgccgatgtgatgaccttcgaccacgagcacgtccccaacgaacacctgcaccaactcatcgcagaaggcgtcaacgttcagccacgcccagaagcgctggtcaacgcacaagacaaacttgtcatgcgcaagcgtctacgtgaactcggcgcaccagtcccaccatttgctgccattgaatcagtcgaagatgcagtgggattcttcgaagcagttgatggccaagtttgcctcaaagcacgccgtggcggatacgacggcaagggcgtatggttcccagccgatgtagcagagcttcagtcgcttgtggcagagcttctcgacggcggcaccccactcatggcagaaaagaaagttgccctcaacagggaactgtccgccatggttgcccgcaccccaagtggagaaaccaaagcgtggccagtcgtagaatcagtgcagaagaacggtgtgtgtgcagaagcaatcgctcccgcacctgaactatccgcagaactgcaggaatccaccagaggattggcccagaagatcgccacggaactcggcgtcactggtgtcttggcagtggagctttttgaaaccctcgaccaaaacggccagccagagatctttgtcaacgagctcgccatgcgtccacacaacaccggccactggactcaagatggctgcgtgaccagccaattcgagcagcacctccgcgcagtcctcgactacccactgggtgctaccgacactttggctgattacaccgtgatggccaacgtgctcggtgccgacaccgacccagagatgcccatggcaacccgcatggtggaagtggggcgcaagtacccagatgccaagattcacctctacggcaagggacatcgcccgggacgaaagattggccacgtcaacatggtgggatccgaccttgaaaagacccgagccgaagccctggcctgcgcatacttccttgtcaacgctcgctgggattag

SEQ ID NO: 13683 - protein, 387 aa, Corynebacterium glutamicum ATCC 13032
MPIVAVIGDGQLARMMQTSAIELGQSLRVLAGAPDSSAAQVAADVVLGDYTNIDDLRVAIEGADVMTFDHEHVPNEHLHQLIAEGVNVQPRPEALVNAQDKLVMRKRLRELGAPVPPFAAIESVEDAVGFFEAVDGQVCLKARRGGYDGKGVWFPADVAELQSLVAELLDGGTPLMAEKKVALNRELSAMVARTPSGETKAWPVVESVQKNGVCAEAIAPAPELSAELQESTRGLAQKIATELGVTGVLAVELFETLDQNGQPEIFVNELAMRPHNTGHWTQDGCVTSQFEQHLRAVLDYPLGATDTLADYTVMANVLGADTDPEMPMATRMVEVGRKYPDAKIHLYGKGHRPGRKIGHVNMVGSDLEKTRAEALACAYFLVNARWD

SEQ ID NO: 13684 - DNA, 1110 bp, Streptococcus pyogenes MGAS8232
  CDS (1)..(1110): transl_table=11
atgaggaacaaggaaaaatcgcagaggagtcaagtggtgaactcatttaagaccattgggattatcggtggtggtcagctggggcagatgatggcgattgcggctatctatatgggccacaaggtcatcacgctggatcctgctagcgactgccctgcctcccgcgttagcgaggtgattgtggcgccttacgatgatgttgaggctttgggacaattggctgcgcgttgcgatgtgttgacttatgagtttgagaatgttgatgcggacggtttggatgccgttgtgtcagcttgtcagctaccgcaggggaccgatctgcttcgcatttcccaaaaccgtatctttgaaaaagactttctggcaaataaggctggtgtgactgtcgctccctataaggtggtgacgtctagccttgacttagaggggcttgatttgaccaagacctatgtcctcaagacggcgacaggtggttatgacggtcatgggcaaaaggttatccgctcagcagaagatttgccagaggcgcagcaattagctaactcagctcagtgtgtcttggaagagtttgtcaatttcgaccttgaaatctcagttatcgtgtctggaaacggagaggatgtgacggtctttcccgttcaggaaaatatccactgcaataatatcctgtcaaaaactatcgtgccagctcgcatcttagatcaactggctgataaggctaagaaaatggcggtgcagattgccaagaaactccagctgtcaggaactctctgtgtggaaatgtttgcgaccgcagatgatatcattgtcaatgaaattgccccacgtccccacaactcagggcactactcaatcgaggcttgcgacttttcacagtttgacacccacattttgggcgtgctaggagcgccgctcccaaccatccacctccatgctccagccgtcatgctcaatgtcctcggacaacacgtccagcaggcaattgactatgtgactgaaaaccctagcgcccacctccacatgtatggtaaactagaagcgaaacataaccgcaaaatgggacatgtgacactatttgcagaagatgcggatgaggtggaggagttttag

SEQ ID NO: 13685 - protein, 369 aa, Streptococcus pyogenes MGAS8232
MRNKEKSQRSQVVNSFKTIGIIGGGQLGQMMAIAAIYMGHKVITLDPASDCPASRVSEVIVAPYDDVEALGQLAARCDVLTYEFENVDADGLDAVVSACQLPQGTDLLRISQNRIFEKDFLANKAGVTVAPYKVVTSSLDLEGLDLTKTYVLKTATGGYDGHGQKVIRSAEDLPEAQQLANSAQCVLEEFVNFDLEISVIVSGNGEDVTVFPVQENIHCNNILSKTIVPARILDQLADKAKKMAVQIAKKLQLSGTLCVEMFATADDIIVNEIAPRPHNSGHYSIEACDFSQFDTHILGVLGAPLPTIHLHAPAVMLNVLGQHVQQAIDYVTENPSAHLHMYGKLEAKHNRKMGHVTLFAEDADEVEEF

SEQ ID NO: 13686 - DNA, 1143 bp, Xanthomonas campestris pv. campestris str. ATCC 33913
  CDS (1)..(1143): transl_table=11
atgactacggtcggcatcctgggcggcggccaattggcgcgcatgctggtgttggccggtgcgccgctggggctgcggtttgccgtgttcgatccggcagccgacgcctgcgcagggcaggtggcgccgttgcaggtgggcgcattcgacgacgcagccgcactagctggcttcgccgcgcaggtggacgtgctcaccttcgatttcgagaacgtaccggccgccagcgcgcagcagttggcgacgcaggtgccggtgttccccaaccctgccgcactggctatcgcgcaagaccggctcagcgaaaaaaccttgttccgcgaactgggtatcccggtgcccgaatttgccgccatcgatgaccgtgccggcctggatgccgcactggcgcgcattggggcgccatgcgtgctcaagacgcgacgcttcggctacgacggcaaggggcagttccggatcaagacgcttgccgacgccgatgctgcgtgggatgccttgggtgcgcaggcggccacggctggcctgatcgtggaagccttcgtgccgttcgagcgcgaagtcagcgtggtcgctgtgcgtggccgcgatggcgggtttcgtgcctggccattgaccgaaaactggcatgtggatggcgtgctctcggccagcctggcgcctgccagcgtggacgccgggttgcaagaggcggctgaagcgcatgcgcgtgcgcttgccgaacgcctggactatgtcggcgtgtttgcattggagctgttcgtgcgcgaaggcaccctgctggccaacgaaatggccccgcgcgtgcacaattccgggcactggacgatcgaaggcgcagaaacttcgcagttcgaaaaccacgtgcgggccgtgctgggcttgccgctcggcagcactgccatgcgtggccatgcctgcatgctgaactggctgggcgccatgcccgatgcagcggccttcctggcagtgcctggtgggcattggcacgattacggcaagcaggcgcgtgatgggcgcaaggtggggcattcgacggtgcgcgcggatacgccggcgctattggcgcaactgcttggcgacgttggtcaggccttgcagcgcgatgcgcagacggcgccggttgtggcgcggttggcgccttag

SEQ ID NO: 13687 - protein, 380 aa, Xanthomonas campestris pv. campestris str. ATCC 33913
MTTVGILGGGQLARMLVLAGAPLGLRFAVFDPAADACAGQVAPLQVGAFDDAAALAGFAAQVDVLTFDFENVPAASAQQLATQVPVFPNPAALAIAQDRLSEKTLFRELGIPVPEFAAIDDRAGLDAALARIGAPCVLKTRRFGYDGKGQFRIKTLADADAAWDALGAQAATAGLIVEAFVPFEREVSVVAVRGRDGGFRAWPLTENWHVDGVLSASLAPASVDAGLQEAAEAHARALAERLDYVGVFALELFVREGTLLANEMAPRVHNSGHWTIEGAETSQFENHVRAVLGLPLGSTAMRGHACMLNWLGAMPDAAAFLAVPGGHWHDYGKQARDGRKVGHSTVRADTPALLAQLLGDVGQALQRDAQTAPVVARLAP

SEQ ID NO: 13688 - DNA, 1146 bp, Xanthomonas axonopodis pv. citri str. 306
  CDS (1)..(1146): transl_table=11
atgagcacgctcggcattctgggtggcggccagctggcgcgcatgctggtacttgccggtgcgccgctcggcatacgctttgcggtcttcgatccggtagccgatgcctgcgctggccaggtggcaccgctgcaggttggcgcgttcgatgacgtggcgacccttgccgcattcgccgagcaggtggatgtgatcactttcgatttcgaaaacgtgccggccaccagcgcgcagcaacttgccgcccaggtgccggtgtttcccagtccggctgcgcttgcggttgcgcaggaccggctcagcgaaaaaaccttgttccgcgagctcggcattccggtgccggagtttgccgcgatcgacgaccgcgccggcctggatgcagcgctcgcacggatcggcacgccctgcgtgctgaagacgcgccgcttcggctacgacggcaagggccagttccgtatcaagtcgctcgccgatgccgatgcagcgtgggacgcgctgggcgcacaggcggcgcacgtcggattgatcgtggaagcgttcgtgccgttccagcgcgaggtcagcgtggttgcagtgcgtgggcgcgatggcgaattccgcgcctggccattgaccgaaaactggcatgtggacggtgtgctgtcggccagcctggcaccggccagcgtggaggcggcactccaagcctcggccgaatcgcacgcgcgtgccgtggcggaaaagctcgactacgtcggcgtatttgcgctggagctgttcatgcgcgacggtgagttgcttgccaacgaaatggcgccgcgcgtgcataactcggggcattggaccatcgaaggcgccgagacctcgcaattcgaaaatcatgtgcgggcggtccttggcttgccactgggcagtactgcgatgcgtggccacgcctgcatgctcaactggctgggtgcgatgccagacgccagggcgtttctggcggtgcccggtgggcattggcacgactatggcaagcaagcccgcgatggacgcaaggtggggcacgcaacgctgcgcgcggagacggcgcaggcgcttgcgctggcagtgagcgacgccggcgcggcgctgcagcgcgatgcgcaagcccggccggtggttgcgcgtttgaacgaagggtga

SEQ ID NO: 13689 - protein, 381 aa, Xanthomonas axonopodis pv. citri str. 306
MSTLGILGGGQLARMLVLAGAPLGIRFAVFDPVADACAGQVAPLQVGAFDDVATLAAFAEQVDVITFDFENVPATSAQQLAAQVPVFPSPAALAVAQDRLSEKTLFRELGIPVPEFAAIDDRAGLDAALARIGTPCVLKTRRFGYDGKGQFRIKSLADADAAWDALGAQAAHVGLIVEAFVPFQREVSVVAVRGRDGEFRAWPLTENWHVDGVLSASLAPASVEAALQASAESHARAVAEKLDYVGVFALELFMRDGELLANEMAPRVHNSGHWTIEGAETSQFENHVRAVLGLPLGSTAMRGHACMLNWLGAMPDARAFLAVPGGHWHDYGKQARDGRKVGHATLRAETAQALALAVSDAGAALQRDAQARPVVARLNEG

SEQ ID NO: 13690 - DNA, 1020 bp, Streptococcus pyogenes MGAS315
  CDS (1)..(1020): transl_table=11
atggccattgcggctatctatatgggccacaaggtcatcacgctggatcctgctagcgactgccctgcctcccgcgttagcgaggtaattgtggcgccttacgatgatgttgaggctttgggacaattggctgcgcgttgcgatgtattgacttatgagtttgagaatgttgatgcggacggtttggatgccgttgtgtcagcttgtcagctaccgcaggggaccgatctgctccgcatttcccaaaaccgtatcgttgaaaaagactttctggcaaataaggctggtgtgacagtcgctccctataaggtggtgacgtctagccttgacctaggggggcttgatttgaccaagacctatgtcctcaagacagcgacaggtggttatgacggtcatgggcaaaagattatccgctcagcagaagatttgccagaggcgcagcaattagctaactcagctcagtgtgtcttggaagagtttgtcaatttcgaccttgaaatctcagttatcgtgtctggaaacggagaggatgtgacggtctttcccgttcaggaaaatatccaccgcaacaatatcctgtcaaaaaccatcgtaccagctcgcatctcagatcaactggctgataaggctaagaaaacggcggtgcagattgccaagaaactccagctgtcaggaactctctgtgtggaaatgtttgcgaccgcagatgatatcattgtcaatgaaattgccccacgtccccacaactcagggcactactcaatcgaggcttgcgacttttcacagtttgacacccacattttgggcgtgctaggagcgccgctcccaactatccacctccatgctccagccgtcatgctcaatgtcctcggacaacacgtccagcaggcgattgactatgtgactgaaaaccctagcgcccacctccacatgtatggtaaactagaagcgaaacataaccgcaaaatgggacatgtgacactatttgcagaagatgcggatgaggtggaggagttttag

SEQ ID NO: 13691 - protein, 339 aa, Streptococcus pyogenes MGAS315
MAIAAIYMGHKVITLDPASDCPASRVSEVIVAPYDDVEALGQLAARCDVLTYEFENVDADGLDAVVSACQLPQGTDLLRISQNRIVEKDFLANKAGVTVAPYKVVTSSLDLGGLDLTKTYVLKTATGGYDGHGQKIIRSAEDLPEAQQLANSAQCVLEEFVNFDLEISVIVSGNGEDVTVFPVQENIHRNNILSKTIVPARISDQLADKAKKTAVQIAKKLQLSGTLCVEMFATADDIIVNEIAPRPHNSGHYSIEACDFSQFDTHILGVLGAPLPTIHLHAPAVMLNVLGQHVQQAIDYVTENPSAHLHMYGKLEAKHNRKMGHVTLFAEDADEVEEF

SEQ ID NO: 13692 - DNA, 1137 bp, Thermosynechococcus elongatus BP-1
  CDS (1)..(1137): transl_table=11
gtggataaaataacgcggattggtgtcattggtggtggccagttggcttggatgctggccctggcggccaaggaaatgggactttccctgtgggtacaaacccctgcagcaacggatcccgccgtcgcggttgccgatggcgtgtgctatggggcgatcgccgatggggcgaccacagcccaactggctgagcacgttgatgtgattacctttgagaatgagtttgttgatctggagcgactccagcaccttgagcagcagggagtttgtttttatcctcgcttggctactttggctcccctcctgaacaaataccagcagcggcgcttcttacaggccctggggattcctgtaccagcgttcacctatttgggggatcgcccccccagctttccctgtgtgattaaagcctgtcgccatggctacgacggccaagggacgtttgtcattaccgatgagcaggcctggcagcagtttcagcaacgctggccagaaattccgccccaagggtttttggtggaagcctttgtgccctatgtcaaagaactggcaatcatggcagcgcgatcgccccaaggggagattgccctttatccggtggtggaaacgcagcaggtggctgccatctgtcgctgggtgatggcccctgcccctattgccccccaagtcagtgagcaaattcagcagatggcccgccaaatcctgacggcccttgatggcgtaggtatctttggcattgagtttttcctcacggccacgggggaagtactggtgaatgaaattgccccccgcacccataattccggacactacaccattgatgcctgtgtcacgagtcaatttcagcagcatttgcgcgccattagtggccagcccttaggcagtcctgacatgcgggtaagcgcagccgtcatggtcaatctccttggcttagccgagccgcaggttgactatggagcaaaatgtcaggccttggcggctctcccccacgcgaacctgcactggtatggtaaaagtcaaacctatgccggtcgcaagttggggcatatcaccgttcttttggaggacccagcggcagcaatgggaatcatccaggaaattgaagccatctggtatagtacgcctgttgcggtgtga

SEQ ID NO: 13693 - protein, 378 aa, Thermosynechococcus elongatus BP-1
MDKITRIGVIGGGQLAWMLALAAKEMGLSLWVQTPAATDPAVAVADGVCYGAIADGATTAQLAEHVDVITFENEFVDLERLQHLEQQGVCFYPRLATLAPLLNKYQQRRFLQALGIPVPAFTYLGDRPPSFPCVIKACRHGYDGQGTFVITDEQAWQQFQQRWPEIPPQGFLVEAFVPYVKELAIMAARSPQGEIALYPVVETQQVAAICRWVMAPAPIAPQVSEQIQQMARQILTALDGVGIFGIEFFLTATGEVLVNEIAPRTHNSGHYTIDACVTSQFQQHLRAISGQPLGSPDMRVSAAVMVNLLGLAEPQVDYGAKCQALAALPHANLHWYGKSQTYAGRKLGHITVLLEDPAAAMGIIQEIEAIWYSTPVAV

SEQ ID NO: 13694 - DNA, 1092 bp, Streptococcus agalactiae 2603V/R
  CDS (1)..(1092): transl_table=11
atgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttctaa

SEQ ID NO: 13695 - protein, 363 aa, Streptococcus agalactiae 2603V/R
MNSFKTIGIIGGGQLGQMMAIAAIYMGHKVITLDPASDCPASRVSEVIVAPYDDVEALGTLAARCDVLTYEFENVDADGLDAVVSAGQLPQGTDLLRISQNRIFEKDFLANKAGVTVAPYKVVTSSLDLEGLDLTKTYVLKTATGGYDGHGQKVIRSAEDLPEAQQLANSAQCVLEEFVNFDLEISVIVSGNGQDVTVFPVQENIHRNNILSKTIVPARISDQLADKAKEMAVQIAKKLQLSGTLCVEMFATADDIIVNEIAPRPHNSGHYSIEACDFSQFDTHILGVLGAPLPPIKLHAPAVMFNVLGQHVQQAIDHVAQNPSAHLHMYGKLEAKHNRKMGHVTVFSDVPDEVEEFEERMDF

SEQ ID NO: 13696 - DNA, 1134 bp, Oceanobacillus iheyensis HTE831
  CDS (1)..(1134): transl_table=11
ttgcagactactaatactatcttaccttcacaaacaattggaattattggtggtggacaattaggaagaatgatggcaatcgctgcacggtatatgggatataagattgttgttttagacccgactccagattgccctactgcacatgtggcagaccaacaaattgttgctgcttatgatgatttacatgcaattgatcagttaatagatggttgtgacgtgattacatatgaatttgaaaatgtggatttacaagctgctgcaatcattcatcagtctggtaagttaccgcaaggaacacgtgctctagaagtaactcaaaaccgtgaaaaagaaaaacaagtcgtatctgatttacgattgccagtcccagactattatattgttacaagtacagaagaatgtgaacatgcgcttgattccattgcttttccagcagtgatcaaaacgtgtcgtggtggttatgatggtaaaggacaattaaaaattcataacgaatctgaaaaagaacaagcgatccaattttttaagctacatggatattgcattattgagcaatggattacatttgataaagaagtatcggtagtgtttacaaggtctataaatggggatattgagttctttcctttagcagagaacgaacatcgtgatcacattctatacaaaacaactgttccagctaatgtagaccaatctattcatgactctgcctgtcagatagctaaaaaaattgcggattatatggatattgtcggtacttttgctattgaaatgtttgtaaaaggaaaagaagtctatgtcaatgaaatggctcctcgtcctcacaattcagggcattatacaatcgaaggctgcaatatttcgcaattcgcccagcatatccgagcaatttgcggtttgccattaatcgaagtggagttacatggtccaacggctatgattaatgttttaggaaatgatataaaatatgcaaaaacgtttctttccagatcgaatgttggctttcttcatttgtatggaaaagaagagccgaaagaaaaacgaaaaatgggacatattacattcactgcgaagacaacagaagaactagagaaacaagtgaattacttcaaggaggaaatacattcatga

SEQ ID NO: 13697 - protein, 377 aa, Oceanobacillus iheyensis HTE831
MQTTNTILPSQTIGIIGGGQLGRMMAIAARYMGYKIVVLDPTPDCPTAHVADQQIVAAYDDLHAIDQLIDGCDVITYEFENVDLQAAAIIHQSGKLPQGTRALEVTQNREKEKQVVSDLRLPVPDYYIVTSTEECEHALDSIAFPAVIKTCRGGYDGKGQLKIHNESEKEQAIQFFKLHGYCIIEQWITFDKEVSVVFTRSINGDIEFFPLAENEHRDHILYKTTVPANVDQSIHDSACQIAKKIADYMDIVGTFAIEMFVKGKEVYVNEMAPRPHNSGHYTIEGCNISQFAQHIRAICGLPLIEVELHGPTAMINVLGNDIKYAKTFLSRSNVGFLHLYGKEEPKEKRKMGHITFTAKTTEELEKQVNYFKEEIHS

SEQ ID NO: 13698 - DNA, 1179 bp, Bifidobacterium longum NCC2705
  CDS (1)..(1179): transl_table=11
atgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggctatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcccctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtga

SEQ ID NO: 13699 - protein, 392 aa, Bifidobacterium longum NCC2705
MPSLSEETGGRVSMLMPGSTIGIIGGGQLGRMMALSARYMGFRVGVLDPTPNCPTGQVADFQITAEYDDKTAIHDLAVQSDVLTYEFENVDAGAIDEVRGITATPQGTDLLRVTQHRVREKQFINDHGTATAPWRAVNNFDELDAALGDIHYPAVLKTVSGGYDGHGQLVLRSDADLEKIRSRSDRGGGFPPSILEGFVDFAFEASILVSGNGKDFVTFPIVRNEHRNNILHMTIAPAEVSEHVAREAHELAIRLAKGFELAGTLAIELFITKDDQVIVNELAPRPHNSGHYTIEACSMDQFDAHIRGIAGWPLPKPKLLSPAVMVNVLGQHVEPTRALIATHPEWNVHDYGKAEVRHDRKMGHITVLTDDPAKTVADLEATGCWDDLKKKA

SEQ ID NO: 13700 - DNA, 1014 bp, Brucella suis 1330
  CDS (1)..(1014): transl_table=11
atggcagcggcgcgcttcggttatgaaaccataatccttgagccgcaggccggttgcccggcagcacaggttgccaatcgccagattgtcgccgcctatgatgacccgaaggcgctggccgaacttgccgccgcttccgacgtcatcacctatgaatttgaaaatgtgccagtcagcgccgccgacaagctggctgaaacggcgcttgttctgcccccgcccgccgcactggaaatctctcaggaccgcttcacagaaaagcagtttctcaacgaaagcggcattgaaaccgcgccctggcggctcgtggatgacgaggaaacgctcatcgccgcgctcggcgcactgggcgggcgtggcatcctcaagacacggcgtctgggttatgacggcaaggggcaggtgcgccttgcctccctcgatgaaacccaggcctgcaacgcttttgcagccatcaacaaggcgcctgcgattctcgaaggcttcgtggaattcgagcgcgaagtctccgtcatcgccgcgcgcgatcgcagcggcaatgtcgccatcttcgatcttgcggaaaacgtccacaaggatggcattctcgccacgtccacagtgcctgccgcgatcagcgtacagacggcagaagccgcgcgcacagccgccgaaaaactgttgcacgcgctggactatgtcggtgtgctggggcttgaattcttcgtgctgaaggacggcacgctgctcgccaatgaatttgccccgcgtgtgcataattcgggccactggacggaagcagcctgcgccatttcccaatttgagcagcatatccgcgctatggcgggactgccgctcggcaatacggatcgccatagcgactgtgtgatggaaaacctgattggcgacgatatcgaaaaggttccggcgattctctgcgagaagaacgccgtgctgcatctttacggtaaaaaggaagctcgcgcgggccggaaaatgggccatgtgacccgcataaagccccgcacaatttaa

SEQ ID NO: 13701 - protein, 337 aa, Brucella suis 1330
MAAARFGYETIILEPQAGCPAAQVANRQIVAAYDDPKALAELAAASDVITYEFENVPVSAADKLAETALVLPPPAALEISQDRFTEKQFLNESGIETAPWRLVDDEETLIAALGALGGRGILKTRRLGYDGKGQVRLASLDETQACNAFAAINKAPAILEGFVEFEREVSVIAARDRSGNVAIFDLAENVHKDGILATSTVPAAISVQTAEAARTAAEKLLHALDYVGVLGLEFFVLKDGTLLANEFAPRVHNSGHWTEAACAISQFEQHIRAMAGLPLGNTDRHSDCVMENLIGDDIEKVPAILCEKNAVLHLYGKKEARAGRKMGHVTRIKPRTI

SEQ ID NO: 13702 - DNA, 1092 bp, Streptococcus mutans UA159
  CDS (1)..(1092): transl_table=11
atgaactcaactaaaaccattggcataatcggcggcggtcagctgggtcagatgatggctatcgcggcggtttacatggggcataaggtggtgacgctggatccgacggcggactgtcctgcctcgcgcgtgtctgagatgattgtggcgccttacgatgatgtggatgctttgcgagaaatggctgtgcgttgcgacctgctgacctatgagtttgaaaatgtcgacgctgacggccttgatgcggtcgtaggagacgctcagctgccgcaggggactgatttgctgcgcatttcgcaaaaccgtatttttgaaaagaatttcctcgccaacaaggctggcgtgacggtcgctccatataaggtggtgacctctagcttagacttggaggatttggatttgggcaagacttacgtcttgaaaacggccacaggcggttatgatggtcacggtcaagtcgttattaaatcacacgacgatttagctgccgcgaatcaattagcaaactctgctgagtgcgtcttggaagagtttgtagactttgaccttgaaatctcggtcattatctcaggaaacggcaaggacgtgacagtcttccccgttcaggaaaatatccaccgcaacaatatcctctcaaaaaccattgtcccagcccgcatttcagaccaggtagccgagaaggccaaagccatggcggtgactattgcccaaaaactccagctatcaggaaccctctgtgtggaaatgtttgcgactgctgacgacatcattgtcaacgaaatcgcaccacgcccccacaactcaggccactactccatcgaagcctgcgacttctcacaatttgacacccatatcctaggcgtccttggtcagcccctcccagccatcaaactccacgccccagccgtcatgctcaacgtcctcggccagcacattcaacaagctcaagaatatgtctccaaaaactctagcgcccacctccacctttatggcaaggcagaagccaaacacaaccgcaaaatggggcatgtgactgtgtttagtgataagcctgatgaagtgagggagtttggggaagggattgatttttag

SEQ ID NO: 13703 - protein, 363 aa, Streptococcus mutans UA159
MNSTKTIGIIGGGQLGQMMAIAAVYMGHKVVTLDPTADCPASRVSEMIVAPYDDVDALREMAVRCDLLTYEFENVDADGLDAVVGDAQLPQGTDLLRISQNRIFEKNFLANKAGVTVAPYKVVTSSLDLEDLDLGKTYVLKTATGGYDGHGQVVIKSHDDLAAANQLANSAECVLEEFVDFDLEISVIISGNGKDVTVFPVQENIHRNNILSKTIVPARISDQVAEKAKAMAVTIAQKLQLSGTLCVEMFATADDIIVNEIAPRPHNSGHYSIEACDFSQFDTHILGVLGQPLPAIKLHAPAVMLNVLGQHIQQAQEYVSKNSSAHLHLYGKAEAKHNRKMGHVTVFSDKPDEVREFGEGIDF

SEQ ID NO: 13704 - DNA, 1236 bp, Streptomyces coelicolor A3(2)
  CDS (1)..(1236): transl_table=11
atgcgccccgcaacgggcggtggccggggccggaaacggccggtaaacaggtgggctccgcgcggccgatacgctaggggtgtgacgttccccgtagtcggcatggtcggcggtggccagctcgctcgtatgacacacgaggcgggcatcccgctcggcatcaggttcaagcttctcagtgacactccccaggactctgcggcgcaggtcgtgaacgaagtcgtcgtcggcgactatcgcgatctggacacgttgcgcgagttcgcgcgcggctgtgacgtgatcaccttcgatcacgagcacgtgccgaccgagcacctcaaggccctggaggcggacggcatccccgtccgccccggtcccgaggcgctcgtgcacgcccaggacaagggcgtgatgcgcgcgaagctcgacgcgatcggcgtgccctgcccgcggcaccggatcgtgcgcgatccggccgacgtggccgccttcgcggcggagggcgccgtggagggcggggacggcttccccgtcgtcctcaagacggtccgcggcgggtacgacggcaagggcgtgtgggtcgtggactcggtggcggaggcggccgagcccttccgcgccggggtgcccgtgctggcggaggagaaggtcgacttcgtccgcgagctggccgccaacgtggtccgctccccgcacggccaggcggtggcctaccccgtcgtcgagtcccagcaggtcaagggcgtctgcgacacggtgatcgcccccgcacccgatctggacgaggcgctggccctgcgcgccgaggagatggcgctcggtatcgccaaggagctgggcgtcgtcggacacctcgccgtcgagctgttccagacccgcgacggccgcgtcctcgtcaacgaactggcgatgcgcccgcacaactccggccactggaccatggacggcgcgatcacctcgcagttcgccaaccacgtccgcgcggtcctcgacctccccctcggcgacccgcgcccgcgggccaagtggacggtgatggtcaacgtcctgggcggcgactacccggacatgtactccgcgtacctgcactgcatggcccgcgacccgcagctcaagatccacatgtacggcaaggacgtgaagcccggccgcaaggtcggccacgtcaacacctacggcgacgacctggacgacgtgctggagcgcgcccgtcacgctgccggttacctgagagggacgatcaccgaatga

SEQ ID NO: 13705 - protein, 411 aa, Streptomyces coelicolor A3(2)
MRPATGGGRGRKRPVNRWAPRGRYARGVTFPVVGMVGGGQLARMTHEAGIPLGIRFKLLSDTPQDSAAQVVNEVVVGDYRDLDTLREFARGCDVITFDHEHVPTEHLKALEADGIPVRPGPEALVHAQDKGVMRAKLDAIGVPCPRHRIVRDPADVAAFAAEGAVEGGDGFPVVLKTVRGGYDGKGVWVVDSVAEAAEPFRAGVPVLAEEKVDFVRELAANVVRSPHGQAVAYPVVESQQVKGVCDTVIAPAPDLDEALALRAEEMALGIAKELGVVGHLAVELFQTRDGRVLVNELAMRPHNSGHWTMDGAITSQFANHVRAVLDLPLGDPRPRAKWTVMVNVLGGDYPDMYSAYLHCMARDPQLKIHMYGKDVKPGRKVGHVNTYGDDLDDVLERARHAAGYLRGTITE

SEQ ID NO: 13706 - DNA, 1074 bp, Streptococcus agalactiae NEM316
  CDS (1)..(1074): transl_table=11
atgaacttatttaagaccattgggattatcggtggtggtcagctggggcagatgatggcaattgcggctatctacatgggccacaaggtcatcacgctggatcctgctagtgactgctctgcctcccgcgttagcgaagtgattgtagcgccttatgatgatgttgaggctttgggacaattagctgcgcgttgcgatgttttgacctatgagtttgagaatgttgatgccgacggtctggatgccgttgtatcggctggtcagctaccgcaggggactgatttgctccgcatttctcaaaaccgtatctttgaaaaagactttctggcaaataaggctggtgtgactgtcgctccttacaaggtggtgacgtctagccttgacctagaggggtttgacttgaccaagacctatgtcctcaagacagcgacaggtggttatgatggtcatgggcaaaaggttatccgctcagcagaagacctgccagaggcgcagcaattagccaactcagccgagtgtgtcttggaagagtttgtcgactttgatcttgaaatctcagtcatcgtgtctggaaatggtcaggatgtgacggtctttcccgttcaggaaaatatccaccgcaacaatatcctatcaaaaactatcgtaccagctcgcatctcagaccaactagctgacaaggctaagaaaatggcggtacagattgccaaggaactccagctatcaggaaccctctgtgtggaaatgtttgtgaccgcagatgatatcatcgtcaatgaaatcgccccacgcccccacaactcagggcactattctatcgaagcctgtgacttttcacagtttgacactcatatcttgggtgtgctggggcaacctctcccaccaatcaagctccatgccccagccgtcatgcttaatgtccttggacaacatgtccagcaggcgattgactatgttgccgaaaaccctagcgctcacctccacatatatggtaaactagaagcgaaacataaccgcaagatgggacatgtgacggtgtttacggaagatgcggatgaggtggaggagttttag

SEQ ID NO: 13707 - protein, 357 aa, Streptococcus agalactiae NEM316
MNLFKTIGIIGGGQLGQMMAIAAIYMGHKVITLDPASDCSASRVSEVIVAPYDDVEALGQLAARCDVLTYEFENVDADGLDAVVSAGQLPQGTDLLRISQNRIFEKDFLANKAGVTVAPYKVVTSSLDLEGFDLTKTYVLKTATGGYDGHGQKVIRSAEDLPEAQQLANSAECVLEEFVDFDLEISVIVSGNGQDVTVFPVQENIHRNNILSKTIVPARISDQLADKAKKMAVQIAKELQLSGTLCVEMFVTADDIIVNEIAPRPHNSGHYSIEACDFSQFDTHILGVLGQPLPPIKLHAPAVMLNVLGQHVQQAIDYVAENPSAHLHIYGKLEAKHNRKMGHVTVFTEDADEVEEF

SEQ ID NO: 13708 - DNA, 1233 bp, Corynebacterium efficiens YS-314
  CDS (1)..(1233): transl_table=11
gtgactttaaacgagacgaacaccagtccagacaacggtgacggcaacccggcggcacacgcaccgggcatgcccgtcgtggctgtgatcggcgacggtcagcttgcccgcatgatgcacaccgaggccatcgaactcggccagtcggtccgcctgctcgccggtgcggcggatgcctccgctgcccaggtcgccgccgacgtggtcatcggtgactacaccaacatcgatgatctgcgtcgtgcactcaaggtcgccgatgtcatgaccttcgaccacgagcatgtgcccaccgagcacctgcgccagctgatctccgagggtgtcaatgtccagccgggccccgatgccctggtcaacgcccaggacaagctggtcatgcgtaaacgcctgcgtgagctgggcgcaccggtgccaccgttcgccgcgatcgacagcctcgaggatgcactcgccttctccgaggccgtggacgggcaggtgtgcctcaaggcccgtcgcggtggttatgacggccacggcgtgtggttcccggaggggcgggatgagttggaggaactcgtcgtcaagctcctggacgccggcaccgcactgatggcggagaagaaggtcacgctggcccgggagctgtccgcgatggtcgcgcgcaccccgtccggggagacggccgcgtggccggttgtggaatcggtgcagcgcggtggggtgtgcgccgaggccgtggcccccgcgccggagctgtcgccgcagctgcaggactccacccgcgggctggccgagcgcatcgccaccgaactgggtgtcaccggtgtcctcgccgtcgagctgttcgagacccgcgatgccaacggccagccggagatctttgtcaatgagctggccatgcgcccgcacaacaccggccactggacccaggacgggtgtgtgaccagccagttcgagcagcacctgcgcgccgtgctcgattacccgctcggctccaccgacacgctcgccacctacaccgtcatggccaatgtcctggccgccgacgtggatccggccgagccgatggcgcgccgcatggccgaggtgtggaagcggtacccgaatgccaagatccacctctacggcaaggggttccgcccgggccgcaagatcggacacgtcaacatggtcggtgaggatctggcgaccgtgcgcgccgaggcccgcgccgcggccaactacctggtcaacgccacctgggcgtag

SEQ ID NO: 13709 - protein, 410 aa, Corynebacterium efficiens YS-314
MTLNETNTSPDNGDGNPAAHAPGMPVVAVIGDGQLARMMHTEAIELGQSVRLLAGAADASAAQVAADVVIGDYTNIDDLRRALKVADVMTFDHEHVPTEHLRQLISEGVNVQPGPDALVNAQDKLVMRKRLRELGAPVPPFAAIDSLEDALAFSEAVDGQVCLKARRGGYDGHGVWFPEGRDELEELVVKLLDAGTALMAEKKVTLARELSAMVARTPSGETAAWPVVESVQRGGVCAEAVAPAPELSPQLQDSTRGLAERIATELGVTGVLAVELFETRDANGQPEIFVNELAMRPHNTGHWTQDGCVTSQFEQHLRAVLDYPLGSTDTLATYTVMANVLAADVDPAEPMARRMAEVWKRYPNAKIHLYGKGFRPGRKIGHVNMVGEDLATVRAEARAAANYLVNATWA

SEQ ID NO: 13710 - DNA, 1083 bp, Pseudomonas putida KT2440
  CDS (1)..(1083): transl_table=11
atgaagatcggtgtaatcggtggcggccagctgggccgcatgctggccttggcgggtaccccgctgggcatgaacttcgccttcctcgacccggcaccggacgcctgcgctgcgcccctgggcgagcacctgcgtgccgactacggcgatcaggaccacctgcgtcagctggccgacgaagtcgacctggtcaccttcgagttcgaaagcgtcccggccgagaccgtggccttcctctcgcagttcgtgcccgtgtaccccagcgccgaatcgctgcgcatcgctcgtgaccgcctgttcgaaaagagcatgttccgcgacctgggcatccccaccccggccttcgccgacatcctctcgcaggccgatctggacgccgcagtggccagcatcggcctgccggccgtgctgaaaacccgcaccctgggttacgacggcaagggccagaaggtgctgcgcacgccagaagacgtggtgggtaccttcgccgagctgggcagcgtgccatgcctgctggagggcttcgtgccgttcaccggcgaggtgtcgctggtggccgtgcgtggccgcgatggtgaaacccgcttctacccgctggtgcacaatacccacgagagcggcattctgcgcttgtcggtagccagccaggcacacccgctgcaggctctggccgaagattacgtcggccgcgtgttgcagaagctggattacgttggcgtgatggccttcgagttcttcgaagttgatggtggcttgaaggccaacgaaatcgccccgcgcgtgcacaactccgggcactggaccatcgaaggcgccgagtgcagccagttcgagaaccatctgcgtgccgtggccggcctgccacttggctcgaccgccaaggtgggcgagagcgcgatgctcaacttcatcggtgaagtgccggccgtggacaaggttgtcgccatcggggactgccacctgcaccactacggcaaggccttcaaggttggccgcaaggtaggacacgccaccctgcgctgccctgacatggccaccctcgagcgcaagattgccgaagtagaggcgctgatcagcaactga

SEQ ID NO: 13711 - protein, 360 aa, Pseudomonas putida KT2440
MKIGVIGGGQLGRMLALAGTPLGMNFAFLDPAPDACAAPLGEHLRADYGDQDHLRQLADEVDLVTFEFESVPAETVAFLSQFVPVYPSAESLRIARDRLFEKSMFRDLGIPTPAFADILSQADLDAAVASIGLPAVLKTRTLGYDGKGQKVLRTPEDVVGTFAELGSVPCLLEGFVPFTGEVSLVAVRGRDGETRFYPLVHNTHESGILRLSVASQAHPLQALAEDYVGRVLQKLDYVGVMAFEFFEVDGGLKANEIAPRVHNSGHWTIEGAECSQFENHLRAVAGLPLGSTAKVGESAMLNFIGEVPAVDKVVAIGDCHLHHYGKAFKVGRKVGHATLRCPDMATLERKIAEVEALISN

SEQ ID NO: 13712 - DNA, 1107 bp, Bradyrhizobium japonicum USDA 110
  CDS (1)..(1107): transl_table=11
gtgactgacgcaaagcaggtgaagctgaagcccggcgacaccatcggaatcctcggcggcggacaattggggcggatgctggccatggccgcggcacggctcggactgcgctgccaggtgttctcgcccgatccggactcgccggccttcgacgtcgtgctgaacgcgacctgcgccgaatatgccgacgtcgaggcgctcgagctgttcgccaacgacgtcgacgtcatcacctacgaattcgagaacgtcccggcggccgccgcgatggtgctggacgcgcgccgcccggtgttgcccaaccgcaagatcctggagaccacccaggaccggctcgccgagaaggatttcgtgacgcggctcggcatcggcaccgcagcctatgccgacgtcacctccgtcccctcgttgcgcgaggcgattttaaggatcggtcttccggccgtgctgaagacccgccgcttcggctatgacggcaagggccaggccatcatccgcgcgggcgacgacatcgccaaggtctggaccagcctcgccaccaaatcggcgatcctggaggccttcgtgccgtacgagcgcgagatctccgtgatcgccgcgcgctcggtcgcgggccaggtggaatgtttcgacgtcaccgagaacgagcaccgcgaccacatcctgaagatatcgcgcgcgcccgcgccgatcccggacgcgctcgccgaagaggcgcgcagcatcgcaagcaagatcgcaagcgcactcgactatgtcggcgtgctggcggtggagatgttcgtgctcgccaatggcaccggaccaaaggtgttggtcaacgagatcgccccgcgcgtgcacaattccggacactggacactcgacggcgcctccgtctcgcaattcgagcagcacatccgcgccattgccggctggccgctcggcaagccggtgcgccacggcgagatcgtcaccatgaccaatctgatcggcgacgagatcaacgattacgagaagtggctgagcgttccgggcgcgaccatccacatctatggcaagggcgcaccgcgccccggccgcaagatgggccatgtcaccgaggtccggccgccccgggacaagtga

SEQ ID NO: 13713 - protein, 368 aa, Bradyrhizobium japonicum USDA 110
MTDAKQVKLKPGDTIGILGGGQLGRMLAMAAARLGLRCQVFSPDPDSPAFDVVLNATCAEYADVEALELFANDVDVITYEFENVPAAAAMVLDARRPVLPNRKILETTQDRLAEKDFVTRLGIGTAAYADVTSVPSLREAILRIGLPAVLKTRRFGYDGKGQAIIRAGDDIAKVWTSLATKSAILEAFVPYEREISVIAARSVAGQVECFDVTENEHRDHILKISRAPAPIPDALAEEARSIASKIASALDYVGVLAVEMFVLANGTGPKVLVNEIAPRVHNSGHWTLDGASVSQFEQHIRAIAGWPLGKPVRHGEIVTMTNLIGDEINDYEKWLSVPGATIHIYGKGAPRPGRKMGHVTEVRPPRDK

SEQ ID NO: 13714 - DNA, 1185 bp, Xylella fastidiosa Temecula1
  CDS (1)..(1185): transl_table=11
atgaagaccctcggtattcttggcggtgggcaactggcccgtatgctggcgttggctgcacccccattgggcgtgcgggtgtgtacctttgatcaaactgttgacgcttgtgctgggcagatgacgccgctctgggttggttgttttgatgatgtggctgcgttgcgtgactttgtcacccgggtggatgtcatcactttcgactctgagaacctgccggttgctagtgtgcaagtactgaaagaacacgtcccggtgtatccgaatccagaggcgcttgcagtggcccaggacaggctgagtgaaaaaaccttgtttcgtgacttggggattccggtgcccgacttcgttgctgtcgacaatcgggctgctttggatgtggcaatcgtcaaggtggggacaccttgtatcctcaagacgcgtcggtttggttacgatggcaaaggccaattccgcatcaagacgttgactgatgcggatgcggcttgggccatgctcggtgagcaagccggaataaccgggttgattttggaagcctttgtgccattccagcgtgagatgagcatccttgctgtgcgcggttgtaacggtcagtttcgttcttggccgttgacagagaattggcatgttgctggcgttctttctgtcagtttggctccaatggccgttgatcccacgctgcaggctgcggctgaagcctatgcgcgtttattggctgagcgattggactatgtgggcgtgttcgcactagagctgttcgtccacgatggtcgattacttgccaacgagatggcaccacgcgtacataactccggacattggacgattgaaggggccgaaacgtcccagtttgaaaatcacctgcgtgctgtatttggcttaccgctcggtagcactgcgatgcgtggttatgcctgcatggtcaattgcttaggtgtcatgcctgatcaacaggcattacttgccctgtcaggcctacattggcacgactatggcaagcagccacgccaagggcgcaaggtcggtcatgccacactacgtgcggatcaacctgcggatttaatggcttctctagagcaggtcggcgcagtacttggggatcaagagcgcgtggctgtggtgctggagcgtttgtccgaggaggtgtcacggagggatgccgttgcggcgtcttcttctgtctga

SEQ ID NO: 13715 - protein, 394 aa, Xylella fastidiosa Temecula1
MKTLGILGGGQLARMLALAAPPLGVRVCTFDQTVDACAGQMTPLWVGCFDDVAALRDFVTRVDVITFDSENLPVASVQVLKEHVPVYPNPEALAVAQDRLSEKTLFRDLGIPVPDFVAVDNRAALDVAIVKVGTPCILKTRRFGYDGKGQFRIKTLTDADAAWAMLGEQAGITGLILEAFVPFQREMSILAVRGCNGQFRSWPLTENWHVAGVLSVSLAPMAVDPTLQAAAEAYARLLAERLDYVGVFALELFVHDGRLLANEMAPRVHNSGHWTIEGAETSQFENHLRAVFGLPLGSTAMRGYACMVNCLGVMPDQQALLALSGLHWHDYGKQPRQGRKVGHATLRADQPADLMASLEQVGAVLGDQERVAVVLERLSEEVSRRDAVAASSSV

SEQ ID NO: 13716 - DNA, 1131 bp, Lactobacillus plantarum WCFS1
  CDS (1)..(1131): transl_table=11
gtgaacgccaattttaaggaagcactcttaccacccgcaacgatcggaatcgttggtggcggtcaactcggtcagatgatgacgcttagcgcgaaggcgatgggctatcgggtaggtgtccttgacccgacacccaaagcaccggcagcccaggtcgcagattttcagattgttgcggcttatgatgatcaggcggctttacttgatctagcgcgccgtagtgatgtcttgacctacgagtttgaaaacgttgatgagaatgctttgattgctgcgcaagcctatgcaaagttaccgcagggcactgcactcctgcatattactggagatcgtcttaatgagaagcaatttcttcatgatcatggcatcccagtcacatctttcgcaccggtgacggatttacagtcattaaattacgccctcaaccgtgttggtacgccggcaattctcaaaacggcggcaggtggctacgatggtcacggacaaacggatctagacacagcagtggtgacaaaagctgctagtgccttattgacacagccgtgcattctagaggcgcggcagaaatttcgaacagaagtttccatgatggtgacgcgtagtgctgctggtgttgttacgacttttccgttagttgaaaatcagcatcaacatcatatcttacacacaacgattgccccagctaatgttcagcccagtgttcatagtgcggcccgcaaaattgcggtttcgattgctgaatctctggaactacgcggcgtgctaggaatcgaattctttgttttaccggatgatactttattagtcaatgaactggcaccacgcccacataattctggtcactatacgattgaggcctgcaacatctcgcagtttgaggcccatattcgaagtatctgtggcttaccgattccggccattacgcagaccagtccggcagtgatgcgtaatctgctaggtgatgacttaacagtggcacgtcaacagttggttgaacacccagaatggcattttcacgactacggtaaggcggccattaagccccagcgcaagatgggtcatgtcaccgtattaaatcacgatattgacgcagcattagcgtcgttggcaaatttgaaaggggaacaataa

SEQ ID NO: 13717 - protein, 376 aa, Lactobacillus plantarum WCFS1
MNANFKEALLPPATIGIVGGGQLGQMMTLSAKAMGYRVGVLDPTPKAPAAQVADFQIVAAYDDQAALLDLARRSDVLTYEFENVDENALIAAQAYAKLPQGTALLHITGDRLNEKQFLHDHGIPVTSFAPVTDLQSLNYALNRVGTPAILKTAAGGYDGHGQTDLDTAVVTKAASALLTQPCILEARQKFRTEVSMMVTRSAAGVVTTFPLVENQHQHHILHTTIAPANVQPSVHSAARKIAVSIAESLELRGVLGIEFFVLPDDTLLVNELAPRPHNSGHYTIEACNISQFEAHIRSICGLPIPAITQTSPAVMRNLLGDDLTVARQQLVEHPEWHFHDYGKAAIKPQRKMGHVTVLNHDIDAALASLANLKGEQ

SEQ ID NO: 13718 - DNA, 1083 bp, Pseudomonas syringae pv. tomato str. DC3000
  CDS (1)..(1083): transl_table=11
atgaagatcggtgtaatcggtggcggccagctcggtcgcatgttggcattggcagggacgccgctgggcatgaacttcgcctttctcgatcccgcgccggatgcttgcgcagctgcgttgggtgagcatttgcgtgccgattatggcgatctggatcatctgcgtcagttggctgacgaagtcgatctggtgacgttcgaatttgaaagcgttccggctgaaaccgtcgcgttcctgtcgcagttcgtgccggtctacccgagtgccgaagcgctgcgcattgcgcgtgaccgctggtttgaaaaaagcatgttcaaggatctgggcattccgaccccggcgttcgccgatatccagtcgcaagccgacctggatgccgccgtggccagcattggtctgcccgctgttctgaaaacccgcaccctgggttatgacggcaagggccagaaggttctgcgttcggcagccgatgtggtcggtacgttcgccgaactgggcagcgtgccttgcctgctggaaggcttcgtgccgttcactggggaagtatccttgattgccgtgcgtgcgcgtgacggtgaaacccgtttttacccgctggtgcacaacactcatgacagcggcattctgcgcctgtccattgccagcaccgatcaccccttgcaggcactggcagaagactatgccgggcgtgtgttgaagcagctcgattacgtcggcgtgcttgcattcgagttcttcgaggtcgacggtggcctgaaagccaacgagattgcaccgcgtgtgcacaactccggccactggaccaccgaaggcgccgagtgcagccagttcgaaaaccacctgcgggcggttgccggtctgccactgggctcgacggccaaggttggcgagagcgccatgctcaactttatcggcgaagtgccatctgtggacaaggtcatggctgtcgaggactgtcacctgcaccactacggtaaagcgttcaaggctggccgcaaagtgggccacgccaccgttcgcagcgccgaccacgccacgctggatcgccaggtgaagttggtcgaagcgctgatcaagccgtaa

SEQ ID NO: 13719 - protein, 360 aa, Pseudomonas syringae pv. tomato str. DC3000
MKIGVIGGGQLGRMLALAGTPLGMNFAFLDPAPDACAAALGEHLRADYGDLDHLRQLADEVDLVTFEFESVPAETVAFLSQFVPVYPSAEALRIARDRWFEKSMFKDLGIPTPAFADIQSQADLDAAVASIGLPAVLKTRTLGYDGKGQKVLRSAADVVGTFAELGSVPCLLEGFVPFTGEVSLIAVRARDGETRFYPLVHNTHDSGILRLSIASTDHPLQALAEDYAGRVLKQLDYVGVLAFEFFEVDGGLKANEIAPRVHNSGHWTTEGAECSQFENHLRAVAGLPLGSTAKVGESAMLNFIGEVPSVDKVMAVEDCHLHHYGKAFKAGRKVGHATVRSADHATLDRQVKLVEALIKP

SEQ ID NO: 13720 - DNA, 1110 bp, Streptococcus pyogenes SSI-1
  CDS (1)..(1110): transl_table=11
atgaggaacaaggaaaaatcgcagaggagtcaagtggtgaactcatttaagaccattgggattatcggtggtggtcagctggggcagatgatggccattgcggctatctatatgggccacaaggtcatcacgctggatcctgctagcgactgccctgcctcccgcgttagcgaggtaattgtggcgccttacgatgatgttgaggctttgggacaattggctgcgcgttgcgatgtattgacttatgagtttgagaatgttgatgcggacggtttggatgccgttgtgtcagcttgtcagctaccgcaggggaccgatctgctccgcatttcccaaaaccgtatcgttgaaaaagactttctggcaaataaggctggtgtgacagtcgctccctataaggtggtgacgtctagccttgacctaggggggcttgatttgaccaagacctatgtcctcaagacagcgacaggtggttatgacggtcatgggcaaaagattatccgctcagcagaagatttgccagaggcgcagcaattagctaactcagctcagtgtgtcttggaagagtttgtcaatttcgaccttgaaatctcagttatcgtgtctggaaacggagaggatgtgacggtctttcccgttcaggaaaatatccaccgcaacaatatcctgtcaaaaaccatcgtaccagctcgcatctcagatcaactggctgataaggctaagaaaacggcggtgcagattgccaagaaactccagctgtcaggaactctctgtgtggaaatgtttgcgaccgcagatgatatcattgtcaatgaaattgccccacgtccccacaactcagggcactactcaatcgaggcttgcgacttttcacagtttgacacccacattttgggcgtgctaggagcgccgctcccaactatccacctccatgctccagccgtcatgctcaatgtcctcggacaacacgtccagcaggcgattgactatgtgactgaaaaccctagcgcccacctccacatgtatggtaaactagaagcgaaacataaccgcaaaatgggacatgtgacactatttgcagaagatgcggatgaggtggaggagttttag

SEQ ID NO: 13721 - protein, 369 aa, Streptococcus pyogenes SSI-1
MRNKEKSQRSQVVNSFKTIGIIGGGQLGQMMAIAAIYMGHKVITLDPASDCPASRVSEVIVAPYDDVEALGQLAARCDVLTYEFENVDADGLDAVVSACQLPQGTDLLRISQNRIVEKDFLANKAGVTVAPYKVVTSSLDLGGLDLTKTYVLKTATGGYDGHGQKIIRSAEDLPEAQQLANSAQCVLEEFVNFDLEISVIVSGNGEDVTVFPVQENIHRNNILSKTIVPARISDQLADKAKKTAVQIAKKLQLSGTLCVEMFATADDIIVNEIAPRPHNSGHYSIEACDFSQFDTHILGVLGAPLPTIHLHAPAVMLNVLGQHVQQAIDYVTENPSAHLHMYGKLEAKHNRKMGHVTLFAEDADEVEEF

SEQ ID NO: 13722 - DNA, 1125 bp, Enterococcus faecalis V583
  CDS (1)..(1125): transl_table=11
ttgaataaacctttaaaagtaggagcaactattggcattataggtgggggacagttagggcgaatgctagtcatgagtggtaaaaaaatgggtttccaaatgattgtgttggacccaacgctcaatagtccagctggtcaagtagctgaccgtcaaattgtggcagcctttgatcagatatctgctttaactgaactagcagagttaagcgatgtgatcacctatgaatttgaaaatattgaagtggcctccctagaaaaggccattccactagaaaagttgccacaaggaacagaattgttaaaaattactcaaaatcgattgcttgaaaaaacgtttcttcaatcgattggctgtaagattgccccttttgcggaagtaaaaagccagaaagagctgccacaagcaatagaaaagattggttttccatgtgtcttaaaaactattcaaggtggatacgatggaaaaggacaagtcgtcttaaaatgcgaagaggatttctcccaagcgactaaattattagctaacgccacttgtgaattagaaaagtgggtgcctttcactaaagaactttcaatcatcgttgcagggaataagcatggttaccaaagctttcctgtatctgaaaacattcatcgaaagaatatcttgcatgaatcaattgtgccagcacgaatttctgagaatgtgcaacaaaaagcagcggaattggcgcaatacattgctgaggaattaaatctatctggggttttagctatcgaaatgtttttaacggattcagaagagttgtacgtcaatgaattagcgccacggcctcataactcaggtcattactctattgaagcttgctcatttagtcaatttgatgcgcatattcgagggattagcaattggggcattgggttaccccaattacttcaatcagtggttatggtgaatctcttaggcgaacacttagaaaaaagctaccagttatgcacgtcaaaacccacttggcaagtccattactatggaaaagccgaatcaaaagttggcagaaaaatgggccacgtcaccattacaacaccttgcttatcagaaacgttaaaggaaattgagactgttggtatttggaacgtaacttaa

SEQ ID NO: 13723 - protein, 374 aa, Enterococcus faecalis V583
MNKPLKVGATIGIIGGGQLGRMLVMSGKKMGFQMIVLDPTLNSPAGQVADRQIVAAFDQISALTELAELSDVITYEFENIEVASLEKAIPLEKLPQGTELLKITQNRLLEKTFLQSIGCKIAPFAEVKSQKELPQAIEKIGFPCVLKTIQGGYDGKGQVVLKCEEDFSQATKLLANATCELEKWVPFTKELSIIVAGNKHGYQSFPVSENIHRKNILHESIVPARISENVQQKAAELAQYIAEELNLSGVLAIEMFLTDSEELYVNELAPRPHNSGHYSIEACSFSQFDAHIRGISNWGIGLPQLLQSVVMVNLLGEHLEKSYQLCTSKPTWQVHYYGKAESKVGRKMGHVTITTPCLSETLKEIETVGIWNVT

SEQ ID NO: 13724 - DNA, 1116 bp, Enterococcus faecalis V583
  CDS (1)..(1116): transl_table=11
atgaacttggataaaccactattacctggtcaagtgattggtatcattggtggcggacatttagcaaaaatgatggcccttagtgcaagagaaatggggtttcgagtgggtgtgctagatccacaaattgattgtcctgctgcacaagttgccgattggcaattattaggagcatataatgatcctgaagcgttagagaaattggcaaaacgtgcccaagtgattacgtatgaatttgaacatgcagatgttgatgcgttaacagcgattcaacatttggcgaatataccgcaaggaacagacattttagcgattacgcaagatcgcttaatggaaaaaagtttcttggaagataataatattgtgattgcaccttatgcaacgattgttagtccgactgatattcaagaagcaattgatggcattggttatccgtgtatcttgaagaatacgcgaggggaaggtcgttatgtactacatagtacttcagacttagcgccatccatgaatcttctgagagaaggaacctgtgtcttggaagcttggattccttacgaaaaagaattatctgttctgatttctggtaatggtcgtggcgaatttgcgacatttccagttgtggaaacaattaaaaaagagcgtaagctacatgaaacgattgcaccagcccgaattgatgacgaagtcagtggtgagttgcaacgaattgctaaggtgattgctaaagcagttggtttagtcggcaccctttcaattgaaatgttttatacagaaacaggcgggatttatgtaaataaaattttacctcgtccagaagatgctgggaatttttcaatagatgcttgttcttttagccaatatgatacgcatattcgtggtttatgtaattggccaatgccaacgattcaactgttgtctgaagcagtcacggtcaatgtgcttggaaatgaagcctatgaaacgatggacattattaatgaacatccagattggcatttccactattatggccacagtgaagcaaaagcgcaacgagcgatggggcatattactatattaaccaaagaaatcgatgaaacactggaagaaattaaagaaacaaagatttggtcgtaa

SEQ ID NO: 13725 - protein, 371 aa, Enterococcus faecalis V583
MNLDKPLLPGQVIGIIGGGHLAKMMALSAREMGFRVGVLDPQIDCPAAQVADWQLLGAYNDPEALEKLAKRAQVITYEFEHADVDALTAIQHLANIPQGTDILAITQDRLMEKSFLEDNNIVIAPYATIVSPTDIQEAIDGIGYPCILKNTRGEGRYVLHSTSDLAPSMNLLREGTCVLEAWIPYEKELSVLISGNGRGEFATFPVVETIKKERKLHETIAPARIDDEVSGELQRIAKVIAKAVGLVGTLSIEMFYTETGGIYVNKILPRPEDAGNFSIDACSFSQYDTHIRGLCNWPMPTIQLLSEAVTVNVLGNEAYETMDIINEHPDWHFHYYGHSEAKAQRAMGHITILTKEIDETLEEIKETKIWS

SEQ ID NO: 13726 - DNA, 1224 bp, Streptomyces avermitilis MA-4680
  CDS (1)..(1224): transl_table=11
atgggcggccccggaagcggcaccctcaggtaccgaaaccggccactatggcgcggccgatactcttggagcgtgacgttcccggtagtcggcatggtcggcgggggtcagctcgctcgtatgacacacgaggcaggcatcccgctcggcatcaggttcaagctcctcagtgacacccctcaggattccgcggcgcaggtcgtcggcgatgtcgtcataggcgactaccgcgacctcgacacgctgcgcgagttcgcgaaggggtgcgatgtgatcaccttcgatcacgaacacgtacccaccgagcacctacgggccctggaggcggacggcatccccgtccgcccggggcctgacgcgctcgtgcacgcccaggacaagggcgtgatgcgggcgaagctcgacgcgatcggggtgccgtccccgcggcaccggatcgtgcgcgacgtcgacgacgtcgccgccttcgcggccgagggcgacggtttccccgtcatcctcaagaccgtccgcggcggctacgacggcaagggggtgtggttcgtgcgctcggccgaggaggccgaggaccccttccgcgcgggcgtcccggtcctcgccgaggagaaggtcgacttcgtacgggaactcgcggcgaacgtcgtgcgctcgccgcacgggcaggcggtcgcctaccccgtcgtcgagtcccagcaggtcgacggcgtctgcgacacggtgatcgcacccgcgcccggcatctcggacgagctggccctcgaggccgaggcgctggccctgcgcatcgcgaaggaactcggcgtcgtcggtcacctggccgtcgagctcttcgagacggtgaccgccgagggcgaccaccgcatcctcgtcaacgaactggcgatgcgcccgcacaactcgggccactggacccaggacggcgcgatcacgtcccagttcgccaaccacgtccgcgcggtcctcgacctccccctcggcgacccgcgcccgcgcgccacgtggacggtcatggcgaacgtcctcggcggcgactacccggacatgtactccgcgtacctgcactgcatggcccgcgacccccagctcaagatccatatgtatggcaaggacgtgaagcccggccgtaaggtcggccacgtgaacacctacggcgacgacctggacgacgtcctcgagcgcgcccgtcacgcagccggttacctgagaggcacgatcaccgaatga

SEQ ID NO: 13727 - protein, 407 aa, Streptomyces avermitilis MA-4680
MGGPGSGTLRYRNRPLWRGRYSWSVTFPVVGMVGGGQLARMTHEAGIPLGIRFKLLSDTPQDSAAQVVGDVVIGDYRDLDTLREFAKGCDVITFDHEHVPTEHLRALEADGIPVRPGPDALVHAQDKGVMRAKLDAIGVPSPRHRIVRDVDDVAAFAAEGDGFPVILKTVRGGYDGKGVWFVRSAEEAEDPFRAGVPVLAEEKVDFVRELAANVVRSPHGQAVAYPVVESQQVDGVCDTVIAPAPGISDELALEAEALALRIAKELGVVGHLAVELFETVTAEGDHRILVNELAMRPHNSGHWTQDGAITSQFANHVRAVLDLPLGDPRPRATWTVMANVLGGDYPDMYSAYLHCMARDPQLKIHMYGKDVKPGRKVGHVNTYGDDLDDVLERARHAAGYLRGTITE

SEQ ID NO: 13728 - DNA, 1152 bp, Bacillus cereus ATCC 14579
  CDS (1)..(1152): transl_table=11
atgacgagaatcattttacctggaaaaacaatcggtattattggaggcggccagctaggaagaatgatggcattggcagctaaggagatgggatataaaattgctgttttagatcctacaaagcattcgccatgtgcacaagttgctgatattgaaattgttgcaccatatgatgatttaaaagcaattcagcatttagcagagataagtgatgttgtcacatatgaatttgagaatattgattatagatgtttacaatggcttgaaaaacatgcgtacttaccacaaggtagtcagttgttaaatacaacacaaaatcgttttacagaaaagaatgcgattgagaaggctgggttaccagtagcaacgtatagattagttcaaaatcaagatcagcttacagaagcaattgctgggttatcattcccttccgtcttaaaaacgacgacaggtggatatgatgggaaaggacaagttgttttaagaagtgaagctgatgttgaggcagcaagaaatcttgtggataaagcagaatgtattttagagaaatgggtgccttttgaaaaagaagtatcagttattgtgattcgtagtgtaagtggtgaaacaaaagtgtttccagtagcagaaaatattcatgtaaataacattttacatgaatctatcgttccagctcgcattacagaagagctttctcaaaaagcaattgcgtatgcaaaggtacttgcggatgaattagaacttgtgggaacactagctgtagagatgtttgctacagataatgttgagatttatattaatgaattagcgccaagacctcacaattcaggacactatacacaggatgcatgtgaaacgagtcaatttggtcaacatattcgagcaatctgtaatttacctctaggagaaacaaatttgttaaaaccagttgtcatggtaaacattttaggcgaacatatagaaggggtcctaagacaagtgaatagattaaccgggtgctatttacacttgtatggaaaagaagaagcaaaagcacagcgaaaaatggggcatgttaatattttaaatgataatattgaagtcgctctagaaaaagcgaagagtttgcatatttgggaccatcaagaacaactgttggagggaaaaagatga

SEQ ID NO: 13729 - protein, 383 aa, Bacillus cereus ATCC 14579
MTRIILPGKTIGIIGGGQLGRMMALAAKEMGYKIAVLDPTKHSPCAQVADIEIVAPYDDLKAIQHLAEISDVVTYEFENIDYRCLQWLEKHAYLPQGSQLLNTTQNRFTEKNAIEKAGLPVATYRLVQNQDQLTEAIAGLSFPSVLKTTTGGYDGKGQVVLRSEADVEAARNLVDKAECILEKWVPFEKEVSVIVIRSVSGETKVFPVAENIHVNNILHESIVPARITEELSQKAIAYAKVLADELELVGTLAVEMFATDNVEIYINELAPRPHNSGHYTQDACETSQFGQHIRAICNLPLGETNLLKPVVMVNILGEHIEGVLRQVNRLTGCYLHLYGKEEAKAQRKMGHVNILNDNIEVALEKAKSLHIWDHQEQLLEGKR

SEQ ID NO: 13730 - DNA, 1131 bp, Nitrosomonas europaea ATCC 19718
  CDS (1)..(1131): transl_table=11
atgtacataaaaccgggctccatgctgggtctgctgggtggcggacaactgggaagaatgtttgccatggcagcacagcaaatgggttaccgggtaaccgtgcttgatccggctgcagaaagccctgcgggaagtatcgctgaacgtcatttgcaggcggactacctgaacgatcaggcactggatgaattaggatcgacctgtgcagcagtcactatcgagtttgagaatgtgccggcccaggcgttacgctacctggcacgacgctgtgtagtcagccctgatgccgaaagtgtttcgatcgcacaaaatcgtattcgcgagaagcagtttcttgctgaaaatggttttccagtcggaccattcaccgttgtccatgacggacaggatctgccccggatcgatgtatccctgttccccgggatactcaagagcagtcagtccggttacgatggtaaagggcaaatgcggatcgaacatgcagatattctgtccgaagcacttacagcacttggcaacaaaccctgcgtgctggaaaaacgattatccctcgctcatgaaatctccgtcgttctggctcgcgataatctggatcagattaccttctttcctgttcccgagaatcaccatgagcggggtatcctggacacgagcatcataccggctacgttgtcagatgagatcgttggaaaagcacgcgcggttgcccgacaagtagccacacgactgaattatgtcggcattctgtgtgtggaattttttgtcctgggcgatggccagatcctggtcaatgagattgcacctcgtccgcataatagcgggcattattcacttaatgcctgtgtgacttcccaattcgagcagcaggttcgcatgttgtgcggactgcctcacggcagcaccaaactggtacaggaggccgctgtcatgaccaatatactcggggatttgtggaaaaatggtgagcctgactggaacagcatactacaacatccgcagaccaaactgcacctgtatggtaaacgtgcagcaaaacctggcagaaaaatggggcacttcactgtgctggcagatacggttgaagaagcattgcagcagactgcacggatcaggcaggatcttcaattctga

SEQ ID NO: 13731 - protein, 376 aa, Nitrosomonas europaea ATCC 19718
MYIKPGSMLGLLGGGQLGRMFAMAAQQMGYRVTVLDPAAESPAGSIAERHLQADYLNDQALDELGSTCAAVTIEFENVPAQALRYLARRCVVSPDAESVSIAQNRIREKQFLAENGFPVGPFTVVHDGQDLPRIDVSLFPGILKSSQSGYDGKGQMRIEHADILSEALTALGNKPCVLEKRLSLAHEISVVLARDNLDQITFFPVPENHHERGILDTSIIPATLSDEIVGKARAVARQVATRLNYVGILCVEFFVLGDGQILVNEIAPRPHNSGHYSLNACVTSQFEQQVRMLCGLPHGSTKLVQEAAVMTNILGDLWKNGEPDWNSILQHPQTKLHLYGKRAAKPGRKMGHFTVLADTVEEALQQTARIRQDLQF

SEQ ID NO: 13732 - DNA, 1221 bp, Rhodopirellula baltica SH 1
  CDS (1)..(1221): transl_table=11
atgagtgacaaccagatacccaaaaccgaacaaacttctgcctcaacacaagtcatcctcccaggtgccacgatcggtatggtcggtggcggacagttgggacggatgtttgccatggcggcggctcgcatgggttatcgcgtcggtgtgttctgtggcagcagcgatgagccggccgccgaggtggctgcgttcacggtttgcggccctctgacagatcattccgcgatcgaagcgtttgcaaagcgttgcgacgtaatcacgttggaatttgagaacattcccgcggacacgatcgcggcctgcagcaaacacgccccgacctatcccgatgcatctgtcttggcgatggcccaagatcgctggattgagaagacgacgcttcgcgaagcggggattccggtggctggttttgagccggtgcatgatcgcgaaacggtagttgctgcgggcgaaaagttggggtggccgatcatcgtcaagacttgtcgaagtggctatgacgggaaggggcagcatcgtctgaactcacctgacgacgcagcaagtgtcgaatgggcaggggccgagagtggcggcgatggccaaccgccatgggttgccgaagcgttggttccatttgaacgagaagcgtcggtgattgtggcccggacgctggatcagcgagtcgagacgtttccggtcttcgaaaacgatcaccaaaatcacatcttggacgaaaccaaacttcccgccgatgtttcgcctgagatggaaacccaagctcgcgaaatcgcaaggcgggtggcggagcacttgggattggtggggcttttgtgcgtggaattgttcgtgacgaaggacgagttgatcgtcaacgaggtggcgccgcggcctcacaattcggggcacgtgacgatcgaagcgtgtgcgaccagccagtttgaacagcatgtccgagcgatctgtggtttgccgcttggtgatacatcgatggtcgttccggcggccagcatgttgaatttattgggtgacatctgggtggcagctgagtcccatggggcgtcgcccaattgggaatcgtgtctggagacgcctggcgttgcattgcatttgtatggcaagcacgcggcgccagcgggacgcaagatggggcacctcaccgcagtcggaaacgatctgccagaggtttccgagcgtttgcgtctggctcgcgagcgattgctcggtggcttgggctga

SEQ ID NO: 13733 - protein, 406 aa, Rhodopirellula baltica SH 1
MSDNQIPKTEQTSASTQVILPGATIGMVGGGQLGRMFAMAAARMGYRVGVFCGSSDEPAAEVAAFTVCGPLTDHSAIEAFAKRCDVITLEFENIPADTIAACSKHAPTYPDASVLAMAQDRWIEKTTLREAGIPVAGFEPVHDRETVVAAGEKLGWPIIVKTCRSGYDGKGQHRLNSPDDAASVEWAGAESGGDGQPPWVAEALVPFEREASVIVARTLDQRVETFPVFENDHQNHILDETKLPADVSPEMETQAREIARRVAEHLGLVGLLCVELFVTKDELIVNEVAPRPHNSGHVTIEACATSQFEQHVRAICGLPLGDTSMVVPAASMLNLLGDIWVAAESHGASPNWESCLETPGVALHLYGKHAAPAGRKMGHLTAVGNDLPEVSERLRLARERLLGGLG

SEQ ID NO: 13734 - DNA, 1170 bp, Prochlorococcus marinus subsp. marinus str. CCMP1375
  CDS (1)..(1170): transl_table=11
ttggaaaataacgaccatcagaatttctgtataggagtggttggtggaggccaacttgctcaaatgttagctaaggcaggaaagaagctgggagtcgatttgattgtccagacaaggtctgaaaacgaccctgctgttcagaatgcaaatggacttgttttgtcagatacaaacgatattaacggaactaggcaactggctcagaaaactagctgcataacttttgagaatgaatgggtagatatagaaggcttgtctctcttagaggattctggtgtcacctttattccaaaactttcagcgatgtcaccccttataaataagctgtctcaacgcaaacttttaaagaaattgaatattcccggtccagaatggctgtctttatcctctttcaaaattagtgatctaaaactagaagctaattggaaatttcctcttatggcaaaatcttcttttggaggttatgacggaaaaggaacaatggttataaacgactttagtgatctaaaaactcttcttcagcaagttaacccaaagcaatggtttttagagaaatggattaactatgataaggagttgtcattggttgtttcaagagatttatttggagaagttagaacatttcctttggttgaaacatttcaaaccaatcaaatttgtaattgggttttagcgcctgcagatgttattcacccagtcattgctatggctaacaatattgcaatttcattagttcgagaattaaattatacgggagtattagctattgaattcttctatggcaatgatggtttgcttgtcaatgaaatagctccaaggactcataactcagctcatttatccatagaagcatgcgcgagtagccagtttgagcatcaaatagctatagcagcaaggaagccagtaaaatctactgaattaattgctccaggggcaataatggttaatctattaggttttaaggattcagaaaacatagttgaaagacgattgcaattactcaagaaaattaacggggttaatcttcattggtacaacaaagaaaataatattcctggtagaaaattaggacatgtgaccaagttgttaagctctattgatataaagcagcgaaggaatgaagcattgcaagtgcttaatcaaatacgatctatttggccaatgacgtag

SEQ ID NO: 13735 - protein, 389 aa, Prochlorococcus marinus subsp. marinus str. CCMP1375
MENNDHQNFCIGVVGGGQLAQMLAKAGKKLGVDLIVQTRSENDPAVQNANGLVLSDTNDINGTRQLAQKTSCITFENEWVDIEGLSLLEDSGVTFIPKLSAMSPLINKLSQRKLLKKLNIPGPEWLSLSSFKISDLKLEANWKFPLMAKSSFGGYDGKGTMVINDFSDLKTLLQQVNPKQWFLEKWINYDKELSLVVSRDLFGEVRTFPLVETFQTNQICNWVLAPADVIHPVIAMANNIAISLVRELNYTGVLAIEFFYGNDGLLVNEIAPRTHNSAHLSIEACASSQFEHQIAIAARKPVKSTELIAPGAIMVNLLGFKDSENIVERRLQLLKKINGVNLHWYNKENNIPGRKLGHVTKLLSSIDIKQRRNEALQVLNQIRSIWPMT

SEQ ID NO: 13736 - DNA, 1191 bp, Bordetella pertussis Tohama I
  CDS (1)..(1191): transl_table=11
atgacgcaatcctccacgttcgatcccattgcttccggcgactggctgggcctgttgggcggcggccagctgggccgcatgttctgtcatgccgcccagagcctgggctacaaggtcgccgtgctcgacccggccgacgagtgtccggccggcatggtggccgatctgcatatccaggccgcctacgacgacgccgacggcctggcgcgcctggccggccgctgccgcgcggtgaccaccgaattcgagaacgtgccggccgacagcctgcgcgcgctggcggcgcgctgccgcgtcagccccgcggccgacgcggtggccgtggtgcaggaccgcatcgccgagaaaaccttcatcgccggccagggcatcgaggtcgccccgcacgccgcgatctgcgcccgcgacgatctgctggccgcgccccaggcgctgttcccgggcatcctcaaggtggcgcgcctgggctacgacggcaagggccaggcgcgcatcgccagccgcgaagaggcgctggccgcgttcgacgagttcggcggcgtcccctgtgtgctggaagcgctgctgccgctggactacgaaatctcggtggtgatcgcgcgcggcttcgacggcgccagcatggtgttcccgatcgcccgcaacgtgcaccgcgacggcatcctggcggtgtcgtccgtgacgccgggcgcggccgacgccagccacgcggcgcgccaggtccaggccacgcaggcggcgcaggccatcgcgcagggcctgggctaccacggcgtgctatgcgtggagttcttcgtgctgggcgacggccggctggtggtcaacgaaatcgcgccgcggccgcacaacagcggccactacaccatcgacgcctgcgtcaccagccagttcgagcagcaggcccgcgtcatggccgggctgccgctgggcagcgccgatctgctggcgccggccgtgatgctcaatatcctgggcgacgtgtggttcgagccgggcgcgcatgcgccgcgcgaacccgactggtccgccgcgctggcggtgccgagcgccaagctgcacctgtacggcaagcgcgaggcgcgccgcggccgcaagatggggcacgtgaccatcgtggccgccacgcccgagcaggcgcgcgacgacgcggcgcgcgtggcgtgcgcgctgggcatggccgcgccgctctga

SEQ ID NO: 13737 - protein, 396 aa, Bordetella pertussis Tohama I
MTQSSTFDPIASGDWLGLLGGGQLGRMFCHAAQSLGYKVAVLDPADECPAGMVADLHIQAAYDDADGLARLAGRCRAVTTEFENVPADSLRALAARCRVSPAADAVAVVQDRIAEKTFIAGQGIEVAPHAAICARDDLLAAPQALFPGILKVARLGYDGKGQARIASREEALAAFDEFGGVPCVLEALLPLDYEISVVIARGFDGASMVFPIARNVHRDGILAVSSVTPGAADASHAARQVQATQAAQAIAQGLGYHGVLCVEFFVLGDGRLVVNEIAPRPHNSGHYTIDACVTSQFEQQARVMAGLPLGSADLLAPAVMLNILGDVWFEPGAHAPREPDWSAALAVPSAKLHLYGKREARRGRKMGHVTIVAATPEQARDDAARVACALGMAAPL

SEQ ID NO: 13738 - DNA, 1191 bp, Bordetella parapertussis 12822
  CDS (1)..(1191): transl_table=11
atgacgcaatcctccacgttcgatcccattgctcccggcgactggctgggcctgttgggcggcggccagctgggccgcatgttctgtcatgccgcccagagcctgggctacaaggtcgccgtgctcgacccggccgacgagtgcccggccggcatggtggccgatctgcatatccaggccgcctacgacgacgccgacggcctggcgcgcctggccggccgctgccgcgcggtgaccaccgaattcgagaacgtgccggccgacagcctgcgcgcgctggcggcgcgctgccgtgtcagccctgcggccgacgcggtggccgtggtgcaggaccgcatcgccgagaaaaccttcatcgccggccagggcatcgaggtcgccccgcacgcagcgatccgcgcccgcgacgatctgctggccgcgccccaggcgctgtttccgggcatcctcaaggtggcgcgtctgggctacgacggcaagggccaggcgcgcatcgccagccgcgaagaggcgctggccgcgttcgacgagttcggcggcgtcccctgtgtgctggaagcgctgctgccgctggagtacgaaatatcggtggtgatcgcgcgcggcttcgacggcgccagcatggtcttcccgatcgcccgcaacgtgcatcgcgacggcatcctggcggtgtcgtccgtgacgccgggctcggccgacgccagccacgcggcgcgccaggtccaggccacgcaggcggcgcaggccatcgcgcagggcctgggctaccacggcgtgctgtgcgtggagttcttcgtgctgggcgacggccggctggtggtcaacgaaatcgcgccgcggccgcacaacagcggccactacaccatcgacgcctgcgtcaccagccagttcgagcagcaggcccgcgtcatggccgggctgccgttgggcagcgccgatctgctggcgccggccgtgatgctcaatatcctgggcgacgcgtggttcgagccgggcgcgcatgcgccgcgcgaacccgactggtccgccgcgctggcggtgcccagcgccaagctgcacctgtacggcaagcgcgaggcgcgccgcggccgcaagatggggcacgtgaccatcgtggccgccacgcccgagcaggcgcgcgacgacgcggcgcgcgtggcgcgcgcgctgggcatggccgcgccgttctga

SEQ ID NO: 13739 - protein, 396 aa, Bordetella parapertussis 12822
MTQSSTFDPIAPGDWLGLLGGGQLGRMFCHAAQSLGYKVAVLDPADECPAGMVADLHIQAAYDDADGLARLAGRCRAVTTEFENVPADSLRALAARCRVSPAADAVAVVQDRIAEKTFIAGQGIEVAPHAAIRARDDLLAAPQALFPGILKVARLGYDGKGQARIASREEALAAFDEFGGVPCVLEALLPLEYEISVVIARGFDGASMVFPIARNVHRDGILAVSSVTPGSADASHAARQVQATQAAQAIAQGLGYHGVLCVEFFVLGDGRLVVNEIAPRPHNSGHYTIDACVTSQFEQQARVMAGLPLGSADLLAPAVMLNILGDAWFEPGAHAPREPDWSAALAVPSAKLHLYGKREARRGRKMGHVTIVAATPEQARDDAARVARALGMAAPF

SEQ ID NO: 13740 - DNA, 1191 bp, Bordetella bronchiseptica RB50
  CDS (1)..(1191): transl_table=11
atgacgcaatcctccacgttcgatcccattgctcccggcgactggctgggcctgttgggcggcggccagctgggccgcatgttctgtcatgccgcccagagcctgggctacaaggtcgccgtgctcgacccggccgacgagtgcccggccggcatggtggccgatctgcatatccaggccgcctacgacgacgccgacggcctggcgcgcctggccggccgctgccgcgcggtgaccaccgaattcgagaacgtgccggccgacagcctgcgcgcgctggcggcgcgctgccgcgtcagccccgcggccgacgcggtggccgtggtgcaggaccgcatcgccgagaaaaccttcatcgccggccagggcatcgaggtcgccccgcacgcagcgatccgcgctcgcgacgatctgctggccgcgccccaggcgctgtttccgggcatcctcaaggtggcgcgcctgggctacgacggcaagggccaggcgcgcatcgccagccgcgaagaggcgctggccgcgttcgacgagttcggcggcgtcccctgtgtgctggaagcgctgctgccgctggagtacgaaatctcggtggtgatcgcgcgcggcttcgacggcgccagcatggtcttcccgatcgcccgcaacgtgcatcgcgacggcatcctggcggtgtcgtccgtgacgctgggctcggccgacgccagccacgcggcgcgccaggtccaggccacgcaggcggcgcaggccatcgcgcagggcctgggctaccacggcgtgctgtgcgtggagttcttcgtgctgggcgacggccggctggtggtcaacgaaatcgcgccgcggccgcacaacagcggccactacaccatcgacgcctgcgtcaccagccagttcgagcagcaggcccgcgtcatggccgggctgccgttgggcagcgccgatctgctggcgccggccgtgatgctcaatatcctgggcgacgcgtggttcgagccgggcgcgcatgcgccgcgcgaacccgactggtccgccgcgctggcggtgcccagcgccaagctgcacctgtacggcaagcgcgaggcgcgccgcggccgcaagatggggcacgtgaccatcgtggccgccacgcccgagcaggcgcgcgacgacgcggcgcgcgtggcgcgcgcgctgggcatggccgcgccgttctga

SEQ ID NO: 13741 - protein, 396 aa, Bordetella bronchiseptica RB50
MTQSSTFDPIAPGDWLGLLGGGQLGRMFCHAAQSLGYKVAVLDPADECPAGMVADLHIQAAYDDADGLARLAGRCRAVTTEFENVPADSLRALAARCRVSPAADAVAVVQDRIAEKTFIAGQGIEVAPHAAIRARDDLLAAPQALFPGILKVARLGYDGKGQARIASREEALAAFDEFGGVPCVLEALLPLEYEISVVIARGFDGASMVFPIARNVHRDGILAVSSVTLGSADASHAARQVQATQAAQAIAQGLGYHGVLCVEFFVLGDGRLVVNEIAPRPHNSGHYTIDACVTSQFEQQARVMAGLPLGSADLLAPAVMLNILGDAWFEPGAHAPREPDWSAALAVPSAKLHLYGKREARRGRKMGHVTIVAATPEQARDDAARVARALGMAAPF

SEQ ID NO: 13742 - DNA, 1191 bp, Prochlorococcus marinus subsp. pastoris str. CCMP1986
  CDS (1)..(1191): transl_table=11
atgaatcaaaaaaaaaatatagaaaatatacagaaaaattattcaataggaataattggaggtggtcaattagctttaatgcttgctgaagctgcaaaaaatagaggaataaaagtatgcgttcaaactaaatcttccaatgatccagcaggttcaaaagcagattatgtaattgaagctgatcccctaaaggtaaaagggaataaggacttaattaaagagtgcgaaaaaattatttttgaaaatgaatggattaaaattgaaaaattgaattcaattgattctaaaaatatttttgtaccaagccttgaatcaattcaacctttggtcgataggatctcccaaaaaatattaatagaaagattgaacctcccatcaccaagatggaaatcaatagaggaatttaaaagtcttaatgatgaagaaattgagtcttggaattttcctctaatgattaaatcttataaaggaggatatgacggtaaaggaaatacaaaaatcaatactagagaagatttaaattctttttttgttgaaaccaattcagaagaatggataattgaagaatgggttgattataaaaatgagtttgctttagtaggatctagagattttgatggaacaataagattctttccaattgtcgagacatttcaaaaaaataatatttgtgattgggttttgtctccagctgaaattgattatgatttgaagacttttgcgaaaaatattttttcatcaatagtaaatgaacttgattatgtaggagtgatgggaattgaatttttttatggtgataaaggactattaattaatgaaatagcccctagaactcataattccgcacacttttctattgaagcttgttcttcaagccagttcgatcaatatgtttgtatatcttcaggcatcaagcctccagaaataaaaatgcattcccaaggatccttaatgataaatttactaggtttaaataaaaaatttcctttgtccataaaaaaaagattagaattattatctcaaatcaggggttctaatctccattggtatggtaaatccaaagaaagtgttggaagaaaaatggctcatataacgtttttacttaacgaagataatcagtcgaaaagatttgtaaaatcaaaagaaatattaaataaggtaagagagatttggccatctccaaatgactaa

SEQ ID NO: 13743 - protein, 396 aa, Prochlorococcus marinus subsp. pastoris str. CCMP1986
MNQKKNIENIQKNYSIGIIGGGQLALMLAEAAKNRGIKVCVQTKSSNDPAGSKADYVIEADPLKVKGNKDLIKECEKIIFENEWIKIEKLNSIDSKNIFVPSLESIQPLVDRISQKILIERLNLPSPRWKSIEEFKSLNDEEIESWNFPLMIKSYKGGYDGKGNTKINTREDLNSFFVETNSEEWIIEEWVDYKNEFALVGSRDFDGTIRFFPIVETFQKNNICDWVLSPAEIDYDLKTFAKNIFSSIVNELDYVGVMGIEFFYGDKGLLINEIAPRTHNSAHFSIEACSSSQFDQYVCISSGIKPPEIKMHSQGSLMINLLGLNKKFPLSIKKRLELLSQIRGSNLHWYGKSKESVGRKMAHITFLLNEDNQSKRFVKSKEILNKVREIWPSPND

SEQ ID NO: 13744 - DNA, 1200 bp, Prochlorococcus marinus str. MIT 9313
  CDS (1)..(1200): transl_table=11
gtggttgattctctctgcatgagcagcgttaaaagcccaatgattggggtcgtcggtggtggtcagttggctcagatgttggcgcaagcagcaaaaagccgcgctgtagatgttgtcgtgcagtctggatctgcaatcgatcccgctgctgttgaagcaactcgacttgtcttggccgacccagtggatgtagaagctactggcaagctcgtgcaggggtgttgtggcgtcacgtttgagaacgaatgggtcgatattgaagctctgattccccttgaacaacaaggggtgtgtttttctccgtctcttactgcgcttgctccattggtcgacaaaatctcgcagcgtcagttgcttcgtgatctagatcttcctagccctgattggactttgctgagttcgatttcttttgctcagccagagcttcctagggagtggaactttccggtgatggccaagtcaagtcggtggggatatgacggcaaaggaaccaaggttctcaagagtgtcgaggatttatcgcaacttctgcgctcagtggatccaactcaatggctgcttgagagctgggtgccgtttgaaaaggaattagccattgttgttagtcgagatgctcagggccgtgttcgtagcctgcctcttgctgagactcatcagttccaacaggtgtgtgattgggtgattgcacctgcgagtgttgatcatgctgtggaaatgatggcctacaacatggcagcgtctcttctaacagagctcaattacgtgggcgtgcttgctgttgaatttttctacggaccagacggactacaggtcaatgaagttgcacctcgcactcataattccgcacatttttcgatcgaagcctgcagcagcagccagtttgatcaacaactttgtatcgcggcgggcttgccagtgcctgaaacccatctccatgcacctggagccttaatggtaaatcttctaggtttgcaaaaagggggtgagtcctctctagatgagcgcctagcgaagctgcgcagttgtgatcgcttccatttgcactggtatggaaaagattgtgaaactccaggccgcaagctcggtcatgtgaccgtgctgcttaatggtgttgatgcgcccagccgtcagctcgaggcggaaactgccttaaagcacattcgctcaatttggccgacgcaggacaccgtttgcgcttaa

SEQ ID NO: 13745 - protein, 399 aa, Prochlorococcus marinus str. MIT 9313
MVDSLCMSSVKSPMIGVVGGGQLAQMLAQAAKSRAVDVVVQSGSAIDPAAVEATRLVLADPVDVEATGKLVQGCCGVTFENEWVDIEALIPLEQQGVCFSPSLTALAPLVDKISQRQLLRDLDLPSPDWTLLSSISFAQPELPREWNFPVMAKSSRWGYDGKGTKVLKSVEDLSQLLRSVDPTQWLLESWVPFEKELAIVVSRDAQGRVRSLPLAETHQFQQVCDWVIAPASVDHAVEMMAYNMAASLLTELNYVGVLAVEFFYGPDGLQVNEVAPRTHNSAHFSIEACSSSQFDQQLCIAAGLPVPETHLHAPGALMVNLLGLQKGGESSLDERLAKLRSCDRFHLHWYGKDCETPGRKLGHVTVLLNGVDAPSRQLEAETALKHIRSIWPTQDTVCA

SEQ ID NO: 13746 - DNA, 1221 bp, Synechococcus sp. WH 8102
  CDS (1)..(1221): transl_table=11
ttgagtggcaagctgctggggattgcgcacccatggggaatgaccaccacggccgagatgatcggtgtcgtcggcggcggacagctcgctcgcatgatggtggaagctgctgcagaacggcaggtggccgtggcagttcagaccggttccaccgacgaccccgcctgtgccggttcgtcccgtcaggtcatcgcggaccctcgtgatgtggcgggaactcgccaattgatggtgggctgccagggaatcacgtttgaaaacgagtgggtcaatattgatgccctcatccccttggaaaagcagggtgtgcggttccgtccggccctttctgccctctcacctctggtaaacaagctgtcgcagcggcagctgttgtcagatctctcgattgccacgccaccgtggtgtccgttgagtcggatctctccggctcagccagccctgcctcaggggtggtcatttccggtgatggcgaaagcggcccacggcggatacgacggcaaggggacagtcgttgtggagtcgattgaggatctggctcgcttgatccgcagtgtggaaagcgatgagtggctgctggagtgctgggtggattacgagcgagagctggcgctggtggtaagtcgtgattcccagggacgggttcgccgtttccctcttgtggaaacccaccaaagccagcaagtctgcgactgggttctggctcctgctgcggttgaccaaggggtggaagctcaggcctacaacgtggcagcgtccctgctcaccaaactcaattacgtcggggttctggccctggagttttttttcggacccgatgggttacaggtgaacgaagtggctccgcgaacacacaattccggccattactcgattgaagcctgtagcagcagtcaatttgaccaacaggtttgcattgccgccggtctgccggttccatcgcctgaattcaccagcaatggtgcactgatggtgaatctgctggggcttgagactgccaccacgtcgctacaacaacgcttggacgccttagcggctttgccggatgcgcatcttcactggtacggcaagtcaccggaaactcctggacgcaaactcggtcacgtgactgtgctgctctcgggggctgatgcaaagcagcgagagcagcaagcccaatccgcactggaggtgatccgcggcatctggccgtctccgacggtgaattcagctctaagctga

SEQ ID NO: 13747 - protein, 406 aa, Synechococcus sp. WH 8102
MSGKLLGIAHPWGMTTTAEMIGVVGGGQLARMMVEAAAERQVAVAVQTGSTDDPACAGSSRQVIADPRDVAGTRQLMVGCQGITFENEWVNIDALIPLEKQGVRFRPALSALSPLVNKLSQRQLLSDLSIATPPWCPLSRISPAQPALPQGWSFPVMAKAAHGGYDGKGTVVVESIEDLARLIRSVESDEWLLECWVDYERELALVVSRDSQGRVRRFPLVETHQSQQVCDWVLAPAAVDQGVEAQAYNVAASLLTKLNYVGVLALEFFFGPDGLQVNEVAPRTHNSGHYSIEACSSSQFDQQVCIAAGLPVPSPEFTSNGALMVNLLGLETATTSLQQRLDALAALPDAHLHWYGKSPETPGRKLGHVTVLLSGADAKQREQQAQSALEVIRGIWPSPTVNSALS

SEQ ID NO: 13748 - DNA, 1131 bp, Chromobacterium violaceum ATCC 12472
  CDS (1)..(1131): transl_table=11
atggccgccatcctgccgccggcgatgctgggcatactcggcggcggacagctcggccgcatgttcgccgtggccgccaaaaccatgggctaccgcgtcaccgtgctggatccggacgagaacgcgccggcggcggccttcgccgaccgccacatccgcgcgccgtacaacgacccggccgcgctgcgcgagctggccgacagctgcgccgccgtcaccaccgaattcgagaacgtcaacgccgacgcgatgcgcgagctggcgcgccgcacccgcgtgtcgccgtccggcgactgcgtcgccgtcgcccaggaccgcatcgccgagaaggcctggatcaacaaggccggcctgccgaccgcgccctacctcgccatcgaaagcgtcgaggacatccaggtggacctggcgccctacctgcccggcatcctgaagaccgcccgcctcggctacgacggcaagggccaggtacgggtgcagaccgccgacgaggcgcgcgccgcctacgccaacctgggcggccaggcctgcgtgctggaaaaaatgctggacctgcagctggaggtgtcggccatcgtcacccgcgtcagcggcgcgcagagcgcggtgtttccggtggcggaaaacatccacaagaacggcatcctcgacgaatccatcgtgccggcgcgcatcgctccggcgctggcggcgcgggcgcaggacatggcccggaaactggccgaggcgctcgactacgtcggcgtgctggcggtggaattcttcgtgctggccgacgacagcctggtggtcaacgagatcgcgccgcggccgcacaactccggccattacacgctcaccgcctgcctgaccgaccagttccagcagcaggtgcgcgcgatgtgcggcctgctgccgggccgcaccgacctgctcagcccggtggtgatggtgaacctgctgggcgacgtgtggaaggacgacggccacgagcccaactgggacgtgctggccgaagcgcccaacgcccagctgcacctgtacggcaagaagcaggcgcggccgggccgcaagatgggccacttcaacgtgatggccgccagcgccgacgaggcgctggagcaggccagggcgctgaaggacaccctgtag

SEQ ID NO: 13749 - protein, 376 aa, Chromobacterium violaceum ATCC 12472
MAAILPPAMLGILGGGQLGRMFAVAAKTMGYRVTVLDPDENAPAAAFADRHIRAPYNDPAALRELADSCAAVTTEFENVNADAMRELARRTRVSPSGDCVAVAQDRIAEKAWINKAGLPTAPYLAIESVEDIQVDLAPYLPGILKTARLGYDGKGQVRVQTADEARAAYANLGGQACVLEKMLDLQLEVSAIVTRVSGAQSAVFPVAENIHKNGILDESIVPARIAPALAARAQDMARKLAEALDYVGVLAVEFFVLADDSLVVNEIAPRPHNSGHYTLTACLTDQFQQQVRAMCGLLPGRTDLLSPVVMVNLLGDVWKDDGHEPNWDVLAEAPNAQLHLYGKKQARPGRKMGHFNVMAASADEALEQARALKDTL

SEQ ID NO: 13750 - DNA, 1146 bp, Gloeobacter violaceus PCC 7421
  CDS (1)..(1146): transl_table=11
gtgcgaccggcagcagggcggacgggcctgccgacggtcggtattgtcgggggcggccagcttggccggatgatggccctggcgggccatgccctgggattgcggctggtggtgctcgaccccgatccggccagccccgcctcccaggtggtgcccgtctcactggagggggcgttcgacgacatcgagagcctgcgctccctggccaggatcaccgacatcgtcacgttcgaaaacgagtgggtggagccgctgctggtcgcccagctggaggcggatggctgccgggtctggcccgccagccggaccctcgcgcgcatccaggacaagttgcaccagcgcacccatctggctgcggccggattgccggtgccgcgcttcgccgccgccccgagtctggaggcggtgcgggcgtggggaggaagccggccgctggtgctcaagacccgccttcagggctacgacggtcacggcgtgcgcatcgtcgagaaccccgcgcacctggaggacgcctgggaggccctcgcaggtcaaccgcttatggtcgaagcgttcgtgacttttgaacgggaactggcggtgatggtggcccgctcctcaaccggcgaggtgcgctcctatccggtggtcgagacgcgccagcgtcggcacgtctgccacactgtgatcgccccggctccagtggacgaagtgatccgcgagcgcgccggagcggttgcccgcgccgccgtcgaggcggtcgagggagtgggcatcttcggtgtcgagctgtttgtggacgcccgcggggaggtgagcatcaatgaactggccccccgcccccacaactccggccattacaccctcgacgcctgcaccaccagccagttcgagcagcacctgcgcgccgtgctcggttggccgctggcggacccatccatgcacagtccggcggcggtgatggtgaacattctggccgaaggcgacgcgcctgaggccgaacccgatctggcggcggccctcgccttcgctggggtcaaagtgcattggtacggcaagcgcggcgcccggcccggccgcaagctcggccacatcaccgccgtcgcccgcgacccggcggtggcctacgagcgtgccctcgccgcccgcgaggcgctggggatatga

SEQ ID NO: 13751 - protein, 381 aa, Gloeobacter violaceus PCC 7421
MRPAAGRTGLPTVGIVGGGQLGRMMALAGHALGLRLVVLDPDPASPASQVVPVSLEGAFDDIESLRSLARITDIVTFENEWVEPLLVAQLEADGCRVWPASRTLARIQDKLHQRTHLAAAGLPVPRFAAAPSLEAVRAWGGSRPLVLKTRLQGYDGHGVRIVENPAHLEDAWEALAGQPLMVEAFVTFERELAVMVARSSTGEVRSYPVVETRQRRHVCHTVIAPAPVDEVIRERAGAVARAAVEAVEGVGIFGVELFVDARGEVSINELAPRPHNSGHYTLDACTTSQFEQHLRAVLGWPLADPSMHSPAAVMVNILAEGDAPEAEPDLAAALAFAGVKVHWYGKRGARPGRKLGHITAVARDPAVAYERALAAREALGI

SEQ ID NO: 13752 - DNA, 1206 bp, Corynebacterium diphtheriae NCTC 13129
  CDS (1)..(1206): transl_table=11
ttgttacccgtgactcacagcaacggtaatccagcagcccacgcgacaaacatgccaattctgtgcgtgatcggcgacggtcaattggcacgaatgatgcataccgcagctatcgagttagggcaatcggtgcgtattctcgcaggagctcctaatgcctccgcagcgcaggtagcagccgacgttgtgctgggggactacaccaacctcgacgatctgcgccgcgtcaccgaaggcgcacacgcagtcaccttcgatcacgaacacgtgcccaaccagcacctagaagcactgatcgcagaaggaatcaacgtccaaccgcggccagctgcattggtcaatgcacaagacaaactcgtgatgcgccagcggctaacagaactcggtgccccagttcccgcattcgcagccatcgacagcgttgaagacgccaccgcattctggaacaccgttgacggtgccgtctgcttgaaagcccgccgcggcggctacgacggcaaaggcgtgtggttccccgacaccctcgaggaacttaccgagctcgtctccgaactactagcagccggaaccccactaatgggcgaacacaaagtgacccttgttcgtgaactatccgccatggtcgctcgcaccccatccggagaagtcaaaggctggccagtcgtagaatccatccaaaaagatggcatctgctggttcgctatcgcacctgcccccgagctctccccagagctgaaagaacaagccgaaaacgttgccatcaccattgccaccgaactcggcgtgaccggcaacctcgccgttgaactgtttgaaactcccgacggcatctttgtcaacgagctagccatgcgcccccacaacacaggccactggacccaagatggctgcgtgaccgaccaattcgagcaacacatccgtgctgtactcgacctaccgctaggatcgaccgcaccgctgcaaaactacaccgtcatggcaaacgttctcggtgctgccgaagaccccgaaacccccatgccacagcgcatgatcgacgtgtggaagcgctacccagaagcgaaaatccacatgtatggcaaagaccatcgcctaggccgcaaaatcggtcacgtcaacatggccggcacggatgcagaagaactgaaaaccgcagctgaaaacgccgcctactacctcgttcacgccgaatggaaggaacaataa

SEQ ID NO: 13753 - protein, 401 aa, Corynebacterium diphtheriae NCTC 13129
MLPVTHSNGNPAAHATNMPILCVIGDGQLARMMHTAAIELGQSVRILAGAPNASAAQVAADVVLGDYTNLDDLRRVTEGAHAVTFDHEHVPNQHLEALIAEGINVQPRPAALVNAQDKLVMRQRLTELGAPVPAFAAIDSVEDATAFWNTVDGAVCLKARRGGYDGKGVWFPDTLEELTELVSELLAAGTPLMGEHKVTLVRELSAMVARTPSGEVKGWPVVESIQKDGICWFAIAPAPELSPELKEQAENVAITIATELGVTGNLAVELFETPDGIFVNELAMRPHNTGHWTQDGCVTDQFEQHIRAVLDLPLGSTAPLQNYTVMANVLGAAEDPETPMPQRMIDVWKRYPEAKIHMYGKDHRLGRKIGHVNMAGTDAEELKTAAENAAYYLVHAEWKEQ

SEQ ID NO: 13754 - DNA, 1101 bp, Rhodopseudomonas palustris CGA009
  CDS (1)..(1101): transl_table=11
gtgagcgcaccccgtcgtgaaccgctgaagcctggcgacactattggaattctcggcggcggccagctcggccggatgctggtgcttgccgcggcccggctcgggctgaagtgccaggtgttctcccccgacccggattcgccggcgttcgacgtggtgcagaacgccacctgcgccgaatatgccgacgtcgaggcactggaattgttcgcctccgaggtcgacgtcatcacctacgaattcgagaacgttcctgcctcagccgcgatggtgctggcggcgcgcaggcctgtgatgccgagccaaaccatcctggagaccacccaggaccggctggccgagaaggacttcgtcaccaagctcggcatcgggactgcggcgtatgctgacgtgacttcgccgcaagcgctgcgcgacgccgtcgcccgcctcggcctgccggcggtgctgaagacccggcggttcggctatgacggcaagggacaggtgatgctgcgcccgggcgacgatccggaagtggcgtgggccacccttgaaacccgcgctgcgattctcgaagccttcgtgccgttcgagcgcgaagtctcggtgatcgccgctcgcggcgccgatggccaggtggtgagttacgacgttaccgaaaacgagcatcgcgaccacattctgaaggtgtccaaggcgccggcggcgatccccgacgcggtcgccaatgaggctcgccggatcgccaagacgatcgccgatgcgctcggttatgtcggcgtgctcggggtcgagatgttcgtggtgcccggttcagacggaccgaaggtgctggtcaacgagatcgccccccgggtgcacaattccggacactggacgctggacggcgcctcggtgtcgcagttcgagcagcacatccgggcaatcgccggctggccgctggccgagccggtgcggcacggggtggtgaccatgaccaacctgatcggtgccgacgttcacgactatacccgctggctgaccgttcccggtgcgaccgtgcatctctacggcaagcgccacgccctgcccggccgcaagatgggtcatgtcaccgtggttgagccggagaagcgctga

SEQ ID NO: 13755 - protein, 366 aa, Rhodopseudomonas palustris CGA009
MSAPRREPLKPGDTIGILGGGQLGRMLVLAAARLGLKCQVFSPDPDSPAFDVVQNATCAEYADVEALELFASEVDVITYEFENVPASAAMVLAARRPVMPSQTILETTQDRLAEKDFVTKLGIGTAAYADVTSPQALRDAVARLGLPAVLKTRRFGYDGKGQVMLRPGDDPEVAWATLETRAAILEAFVPFEREVSVIAARGADGQVVSYDVTENEHRDHILKVSKAPAAIPDAVANEARRIAKTIADALGYVGVLGVEMFVVPGSDGPKVLVNEIAPRVHNSGHWTLDGASVSQFEQHIRAIAGWPLAEPVRHGVVTMTNLIGADVHDYTRWLTVPGATVHLYGKRHALPGRKMGHVTVVEPEKR

SEQ ID NO: 13756 - DNA, 1281 bp, Mycobacterium avium subsp. paratuberculosis K-10
  CDS (1)..(1281): transl_table=11
atggccgtgccgagtacccgcccgccgggcgccgcctccgcgaaagcggcgccccgagccgttccccgcgccgttcccgtcgtcgccatggtcggcggcggccagctcgcccggatgacccaccaggccgcgatcgcgctgggccagtcgctgcgggtgctggccaccgccgccgacgagtcggccgcgctggtcgcgtccgacgtggtgatcggctcgcacaccgacctcgaggacctgcgccggctggccgcgggcgccgacgtgttgaccttcgaccacgagcacgtgccgggcgaactgctggacaagctggtcgccgagggcgtcaacgtggcgccgccgccgcaggccctggtgcacgcgcaggacaagctggtgatgcggcggcggctggaatccctgggtgtgccggtgccgcggtacgccgagatcaacagtctcgacgagctcgacgccttcgcccggcgggtcggcggcccggtggtggtcaaggcggtccgcggcggctacgacgggcgcggcgtgcggatggcccgcgacccggtgcacgcccgggagatcgcggccgccttcctggccgacggcgtgccggtgctggccgaggaacaggtgagcctgcgccgggagctgtccgcgctggtggcccggtcgccgttcgggcagggcgcggcgtggccggtggtcgagacggtgcaacgcgacggcatctgcgtgcaggtgatcgcgcccgcacccggcctgggcgaggacctggccgccgacgcgcaacggctggcgctgcggctggccggcgagctcggcgtggtcggcgtgctggccgtggaactgttcgaaaccaccgacggcgcgctgctggtcaacgagctggcgatgcgtccgcacaactccgggcactggaccatggacgggtcgcggaccggccaattcgagcagcacctgcgcgcggtgctggactatccgctcggcgacaccgacgcgctggcgccggtcaccgtgatggccaacgtgctgggcgcccgggagcggccgcggatgagcgtcgacgagcggctgcaccacctgttcgcgcgcatgcccgacgcccgggtgcacctgtacggcaaggcggaacgccccggccgcaaggtcggtcacatcaacttcctcggcgacttccccgccgccgacacggccgggctggccgcgctgcggcggcgcgccgagctggcggcgcactggctgtcccacgggcagtggacggacggatgggacccacacgaacaggagcggcatcaatga

SEQ ID NO: 13757 - protein, 426 aa, Mycobacterium avium subsp. paratuberculosis K-10
MAVPSTRPPGAASAKAAPRAVPRAVPVVAMVGGGQLARMTHQAAIALGQSLRVLATAADESAALVASDVVIGSHTDLEDLRRLAAGADVLTFDHEHVPGELLDKLVAEGVNVAPPPQALVHAQDKLVMRRRLESLGVPVPRYAEINSLDELDAFARRVGGPVVVKAVRGGYDGRGVRMARDPVHAREIAAAFLADGVPVLAEEQVSLRRELSALVARSPFGQGAAWPVVETVQRDGICVQVIAPAPGLGEDLAADAQRLALRLAGELGVVGVLAVELFETTDGALLVNELAMRPHNSGHWTMDGSRTGQFEQHLRAVLDYPLGDTDALAPVTVMANVLGARERPRMSVDERLHHLFARMPDARVHLYGKAERPGRKVGHINFLGDFPAADTAGLAALRRRAELAAHWLSHGQWTDGWDPHEQERHQ

SEQ ID NO: 13758 - DNA, 1065 bp, Wolbachia endosymbiont of Drosophila melanogaster
  CDS (1)..(1065): transl_table=11
atgaatgaaccagatgcgctgagcaaaaaagtaataggaataataggtggtggacaattaggtaaaatgactgctatcgctgcaacaaaacttggacaaaaaatacatgtttttgccagtgctaaagacgatccagcttgttctattgctgatgatttcacaatagcagatttctctgataagaaagcgcttgaatcttttgcacagagtgtggatttggtcactattgagtctgaaaatattccatgtagtgcaattgatatcgatgtaaatttttatccgggtaaaaaagcgttacacattgcgcaaaataggcttagagagaaagatttcattagaagcttgagtataaaaactgctgaatacaaaagtatacaaaattataatgagctactgaaaagcagtagagcttttggctatccaacaaggctgaaaacaacagaaatgggttatgatggaaaagggcaatatgtgcttgagaatgattctgaagtgaagcaatttgctttctttgattggaatacagagtacattcttgaagcaagtgttgatttactgaaagaggtttcaatagtcgttgcaagagataaaaacggtaaagtagctttttttcctatagcagaaaattaccacgttgatggaatacttgatacttcaacagtgccagctaaaatagatagtaaattaactcaagaggtacaacgagctgcaaagaaaatagcaaatgcgcttgatgtaataggaattctggctattgaattttttgttactaaggataacgaattgttagttaatgaactagctccaagacctcacaattcttgccactggagcttggatgcatgtaacgttagtcaatttgaacagctagttaggataatatgcgggctacctatgcaggaagtagtattacgctttccttgtatgacgaaaaatataataggtaatgatatatatgattctcataagtatttgagcaacgaaaaagctagtttaaccatatatgggaaaaaagaggttagggataagcgtaaaatgggacatgtcaatatagatttaagttaa

SEQ ID NO: 13759 - protein, 354 aa, Wolbachia endosymbiont of Drosophila melanogaster
MNEPDALSKKVIGIIGGGQLGKMTAIAATKLGQKIHVFASAKDDPACSIADDFTIADFSDKKALESFAQSVDLVTIESENIPCSAIDIDVNFYPGKKALHIAQNRLREKDFIRSLSIKTAEYKSIQNYNELLKSSRAFGYPTRLKTTEMGYDGKGQYVLENDSEVKQFAFFDWNTEYILEASVDLLKEVSIVVARDKNGKVAFFPIAENYHVDGILDTSTVPAKIDSKLTQEVQRAAKKIANALDVIGILAIEFFVTKDNELLVNELAPRPHNSCHWSLDACNVSQFEQLVRIICGLPMQEVVLRFPCMTKNIIGNDIYDSHKYLSNEKASLTIYGKKEVRDKRKMGHVNIDLS

SEQ ID NO: 13760 - DNA, 1152 bp, Bacillus cereus ATCC 10987
  CDS (1)..(1152): transl_table=11
atgacgagaatcattttacctggaaaaacaatcggtattattggaggcggccagctaggaagaatgatggcattggcggctaaggagatgggatataaaattgctgttttagatcctacaaaaaactcaccatgtgcacaagttgctgatattgaaattgttgcatcatatgacgatttaaaagcaattcagcatttagcagagatcagtgatgttgtcacatatgaatttgagaatattgattatagatgtttacaatggcttgaaaaacatgcttacttaccgcaaggcagtcagttgttaagtaaaacgcaaaatcgttttacagaaaagaatgcgattgagaaagcaggattaccagtagcaacgtatagattagttcaaaatcaaggtcagcttactgaagcaatcgctgagttatcatatccttctgtcttaaaaacgacgacaggtggatatgatgggaaagggcaagttgttttaagaagtgaggatgacgttgatacagcgcgagagcttgcgaatgcagcagagtgtattttagagaaatgggtgccttttgaaaaagaagtatcagttattgtcattcgtagtgtaagtggtgaaacgaaagtatttccggtagcggaaaatattcatgtaaataacattttgcatgaatccatcgttccagctcgcattacagaagaactttctcaaaaagctattgcttatgcaaaagtgcttgcggatgaactagaacttgtgggaacactagcggtagagatgtttgctacagctgatggtgagatttacattaatgaattagcaccaagacctcacaattcaggacactatacacaggatgcatgtgaaacgagtcaattcggccaacatattcgagcaatctgtaatttacctcttggagaaacaaatttgttaaaaccagttgtcatggtaaacattttaggcgaacatatagaaggggtcctaagacaagtgaatagattaaccgggtgctatttacacttgtatggaaaagaagaagcaaaagcgcagcgaaaaatggggcatgttaatattttaaatgataatattgaagtcgctctagaaaaagcgaagagtttgcatatttgggaccatcaagaacaactgttggagggaaaaagatga

SEQ ID NO: 13761 - protein, 383 aa, Bacillus cereus ATCC 10987
MTRIILPGKTIGIIGGGQLGRMMALAAKEMGYKIAVLDPTKNSPCAQVADIEIVASYDDLKAIQHLAEISDVVTYEFENIDYRCLQWLEKHAYLPQGSQLLSKTQNRFTEKNAIEKAGLPVATYRLVQNQGQLTEAIAELSYPSVLKTTTGGYDGKGQVVLRSEDDVDTARELANAAECILEKWVPFEKEVSVIVIRSVSGETKVFPVAENIHVNNILHESIVPARITEELSQKAIAYAKVLADELELVGTLAVEMFATADGEIYINELAPRPHNSGHYTQDACETSQFGQHIRAICNLPLGETNLLKPVVMVNILGEHIEGVLRQVNRLTGCYLHLYGKEEAKAQRKMGHVNILNDNIEVALEKAKSLHIWDHQEQLLEGKR

SEQ ID NO: 13762 - DNA, 1191 bp, Prochlorococcus marinus str. AS9601
  CDS (1)..(1191): transl_table=11
atgagttttaaaaaaaatataaacgatatcaagaaaaattattccctaggaataattggaggtggtcaactggcactgatgttaaccgaggcagcaaaaaaaagagatttagaagtatgtgtgcaaacaaaatcttgtgatgatcctgctggctcaaaagcagatcatgtcatagaagctgatcctttaaagataagaggaaataaatcattaattaatgagtgtgaaaaaataatttttgaaaatgaatggataaaaattgataaattaaatttaattggcaatgaagatatttttgttccaagccttaatgcaattaagccattagtagataggttttctcaaaaaaaattaatagatagaatgaatattccctgtccaaaatggataagtattgaagattttaaaaatctctcggatgaggaaatcaataattggacttttcctctaatggcaaaatcaaataaaggtggatacgacggcaaagggaacagaaaaataaagacaaaagaagatttagattcttttttaacagagaataattctgatgaatggttaatagaagaatggatagagtatgaaaaagaactggctcttgttggttcgagagataggaccggtaagataagattctttccaatagttgagacgttccaatcaaaccatgtttgtgattgggttcttgcacctggatcaaatgaatatgatttgaacttatttgcaataaatattttctcttcaatagtcaatgaacttaattacgttggagttttagctattgaattcttctatggagataatggtcttttaattaatgaaatagctcctagaacacataactcagctcatttctctattgaagcttgcacatcaagtcagtttgatcaatatgtttgcatttcttctgggataataccacctgaaattaaaatgaactgtgaaggtgcaattatgataaatctactggggttaaaaaagaatttcccaatctcaatggaaaccagaattaaaatgttatctgaaattgagggttctaatattcattgttatggcaaatctcgcgaaattcttggacgaaaaatggctcacatcacatttttattaaatggtaaaacgcattcagaaagatatgatgaagctcaaattttattaactatggtaagagacatttggccatctccaaatgcataa

SEQ ID NO: 13763 - protein, 396 aa, Prochlorococcus marinus str. AS9601
MSFKKNINDIKKNYSLGIIGGGQLALMLTEAAKKRDLEVCVQTKSCDDPAGSKADHVIEADPLKIRGNKSLINECEKIIFENEWIKIDKLNLIGNEDIFVPSLNAIKPLVDRFSQKKLIDRMNIPCPKWISIEDFKNLSDEEINNWTFPLMAKSNKGGYDGKGNRKIKTKEDLDSFLTENNSDEWLIEEWIEYEKELALVGSRDRTGKIRFFPIVETFQSNHVCDWVLAPGSNEYDLNLFAINIFSSIVNELNYVGVLAIEFFYGDNGLLINEIAPRTHNSAHFSIEACTSSQFDQYVCISSGIIPPEIKMNCEGAIMINLLGLKKNFPISMETRIKMLSEIEGSNIHCYGKSREILGRKMAHITFLLNGKTHSERYDEAQILLTMVRDIWPSPNA

SEQ ID NO: 13764 - DNA, 1191 bp, Prochlorococcus marinus str. MIT 9515
  CDS (1)..(1191): transl_table=11
atgactcaaaaaagaaatataaaaaatattagtaaaaattattcactaggaataattggaggaggtcaattagccttaatgcttactgaagcggcaaacaaaagaggaataaaagtatgcgttcaaactaaatcttccaatgacccagcaggctcaaaagcagattgtgttattgaggctgatcctcttaagataaaaggaaataaggatctaattaaaaagtgcgaaaaaattatttttgaaaatgaatggattagaatcgaaaaattaaatttaattgaatctaataatatttttgtaccaagcctgcaatcgattcaacctttggtagatagaatttctcaaaaaaaattaatagagaaaatgggcctgccctcaccaagatggatttcaataaaggattttaaaattcttgagcataaagaaattgaggattggaattttcccttaatggttaaatctcttaaaggaggatatgacggtaaaggaaataaaaaaattaataacaaagaagatttgaattcctttttggttggagcggaatcagacgattggctaattgaagaatggattgactataaaaaggagcttgctctggttggatcaagagattttgatggcaaaataaggctatttcccattgttgagacatttcaaaaaaataacgtttgtgattgggttttgtctccagctgaaattaattatgacttgaaaacttttgtgattaatattttttcctcaatagtaaatgaactcaattatgttggagtaatgggaattgaattcttttatggtgataaaggactattaattaatgaaattgcccctagaactcataattctgctcacttttctatagaggcttgtacttcaagccagttcgatcaatatatttgtatatcttcaggtgccaagcccccagatattaatttgaattctcatggctccttaatgataaatttattaggtttgaaaaaagatttccctttgtcaatagaaaaaaggatagagtttttaacacaaattaaggggtctaaccttcattggtatggaaaatctaaagaaagtgttggacggaaaatgggtcatataacttttttactgaatgagaataattatttgaaaaggaatgaaaaatcaagagaaatattaaataaggtaagagagatttggccatctccaaatgaataa

SEQ ID NO: 13765 - protein, 396 aa, Prochlorococcus marinus str. MIT 9515
MTQKRNIKNISKNYSLGIIGGGQLALMLTEAANKRGIKVCVQTKSSNDPAGSKADCVIEADPLKIKGNKDLIKKCEKIIFENEWIRIEKLNLIESNNIFVPSLQSIQPLVDRISQKKLIEKMGLPSPRWISIKDFKILEHKEIEDWNFPLMVKSLKGGYDGKGNKKINNKEDLNSFLVGAESDDWLIEEWIDYKKELALVGSRDFDGKIRLFPIVETFQKNNVCDWVLSPAEINYDLKTFVINIFSSIVNELNYVGVMGIEFFYGDKGLLINEIAPRTHNSAHFSIEACTSSQFDQYICISSGAKPPDINLNSHGSLMINLLGLKKDFPLSIEKRIEFLTQIKGSNLHWYGKSKESVGRKMGHITFLLNENNYLKRNEKSREILNKVREIWPSPNE

SEQ ID NO: 13766 - DNA, 1146 bp, Prochlorococcus marinus str. NATL1A
  CDS (1)..(1146): transl_table=11
atgattggggtcgtgggtggaggacagcttgcaatgcttttgattgaggctggaaagaaaagaaatgttgatgtcgttgttcagacggctgctaaaactgatcctgctgctaaaaagacaaatcaactcgttttgcatgaccctacgaatcctgtgggtacaaaacttcttgcagaaaagacccgcttgattacttttgaaaatgaatgggttgatatctcaagtttactttctcttgaaaataatggagtttcttttgtccctagacttcaatcaataagacctttaattaataaaataactcaaagggagctattaaacagtcttgatattccctgccctgattggttgtctataccattaaaaaaatcaacagaaattgatcttcctgcagattggggatttcctttgatggcaaaagctgccaaaggtggatatgacgggaaaggaactaaaattattaaaaatctaaagcaacttcaagaatttctatcagttgaaagagaagggcaatggatgttagagaaatggatctcttttgataaggaattatccattgtttctagtagggattcaaaaggaattgtacgtagtctgccaatcgtagagacatatcaatctaaacaagtatgtgactgggtccttgctccagctgatatcaatcatgacgttgatcttatggttagaaatatcgcagcttcgttgcttgctgagttgcaatatgttggagttattgctattgaatttttctatggatctgaaggattacttgtaaatgaaatagctccaagaactcataactcaggtcatttttctattgatgcttgtagcagcagtcagtttgatcaacaaatatgtatcacctctggtattgatgtacccatgcctgaaatgcttgttaatggtgctttaatggcaaacttgcttggtttgcaaagtaactatccaacatcacttacccaaagattgaatgatttgaggggtattcctggcttgaatgttcattggtatgaaaaagaggaagaaaaaaagggcaggaagcttggtcacgttacatatctcttgaataataaggacgctttgtctagaaaaaaagaagcattagatgttttacaaaccatacggtcaatttggccgacctcttga

SEQ ID NO: 13767 - protein, 381 aa, Prochlorococcus marinus str. NATL1A
MIGVVGGGQLAMLLIEAGKKRNVDVVVQTAAKTDPAAKKTNQLVLHDPTNPVGTKLLAEKTRLITFENEWVDISSLLSLENNGVSFVPRLQSIRPLINKITQRELLNSLDIPCPDWLSIPLKKSTEIDLPADWGFPLMAKAAKGGYDGKGTKIIKNLKQLQEFLSVEREGQWMLEKWISFDKELSIVSSRDSKGIVRSLPIVETYQSKQVCDWVLAPADINHDVDLMVRNIAASLLAELQYVGVIAIEFFYGSEGLLVNEIAPRTHNSGHFSIDACSSSQFDQQICITSGIDVPMPEMLVNGALMANLLGLQSNYPTSLTQRLNDLRGIPGLNVHWYEKEEEKKGRKLGHVTYLLNNKDALSRKKEALDVLQTIRSIWPTS

SEQ ID NO: 13768 - DNA, 1212 bp, Prochlorococcus marinus str. MIT 9303
  CDS (1)..(1212): transl_table=11
ttgcaggattgcgtgattgattctctctgcatgagcagcgttacaagcccaatgattggggtcgtcggtggtggtcagttggctcagatgttggcgcaagcagcaaaaagacgcgctgtggatgttgtcgtgcagtcgggatcggcaatcgatcccgctgctgttgaagcaactcgacttgttttggctgacccagtcgatgtagaagctactagcaagctcgtgcagggctgttgtggcgtcacgtttgagaacgaatgggtcgatattgaagctctgattccccttgaacaacaaggggtgtgtttttctccgtctcttactgcgcttgctccattggtcgacaaaatctcgcagcgtcagttgcttcgtgagcttgatcttcctagccctgattggactttgctgagttcgatttcttttgatcagcccgagcttcctacggagtggaactttccggtgatggccaagtcaagccggtggggatatgacggcaaaggaaccaaggttctcaagagtgtcgaggatttgtcgcaacttcagcgctcagtggatccaactcaatggctgcttgagagctgggtgccgttcgaaaaggaattagccattgttgttagtcgagatgctcagggccgtgttcgtagcctgccacttgctgagactcatcagttccaacaggtgtgtgattgggtgatagcacctgcgagtgttgatcatgctgtggaaatgatggcctacaacatggcagcgtctcttctaacagagctcaattacgtgggcgtgcttgctgttgaatttttctacggaccagagggactgcaggtcaatgaagttgcacctcgcactcacaattccgcacatttttcgatcgaagcctgcagcagcagccagtttgatcaacaactttgtatcgcggcgggcttgccagtgcctgcaaccgatctccatgcacctggcgccttaatggtgaaccttctaggtttgcaaaaaggggttgagccctctctagatgagcgcctagcgaagctgcgtagttgtgatcgcttccatttgcactggtatggaaaagattgtgaaactccaggacgcaagctcggtcatgtgaccgtgctgcttcatggtgttgatgcgcccagccgtcagctcgaggcggaaactgccttaaagcatattcgctcaatctggccgacgcaggacaccgtttgcgcttaa

SEQ ID NO: 13769 - protein, 403 aa, Prochlorococcus marinus str. MIT 9303
MQDCVIDSLCMSSVTSPMIGVVGGGQLAQMLAQAAKRRAVDVVVQSGSAIDPAAVEATRLVLADPVDVEATSKLVQGCCGVTFENEWVDIEALIPLEQQGVCFSPSLTALAPLVDKISQRQLLRELDLPSPDWTLLSSISFDQPELPTEWNFPVMAKSSRWGYDGKGTKVLKSVEDLSQLQRSVDPTQWLLESWVPFEKELAIVVSRDAQGRVRSLPLAETHQFQQVCDWVIAPASVDHAVEMMAYNMAASLLTELNYVGVLAVEFFYGPEGLQVNEVAPRTHNSAHFSIEACSSSQFDQQLCIAAGLPVPATDLHAPGALMVNLLGLQKGVEPSLDERLAKLRSCDRFHLHWYGKDCETPGRKLGHVTVLLHGVDAPSRQLEAETALKHIRSIWPTQDTVCA

SEQ ID NO: 13770 - DNA, 1236 bp, Mycobacterium sp. JLS
  CDS (1)..(1236): transl_table=11
gtgccgagccatactccttccacctcttcggcctcttcgccaccggtggtggccatgatcggcgggggtcaactcgcccggatgacccaccaggcggcgatcgcgctgggccagaccctgcgggtgctcgccaccggcccgcaggagccggccgcccaggtgacccccgacgtggtgatcggatcgcataccgacctcgacgcgctccggcgcgcggccgccggtgcgaccgtactgaccttcgaccacgaacacgtccccaccgaagcactcgagacgctggtggccgagggggtcaacgtggcgccgccgccggccgcgctggtgcacgcgcaggacaagctggtgatgcgcaggcgactcgaagcgatgggtgcgccgatcccgcgctacaccgccgtcgacaccgtcgacgacgtcgtggccttctcgtccgaggtcggtggcccggtcgtgctcaagacggtccgcgggggatacgacggccgcggcgtggtgctgaccgccgacgccgacgaggcgcgcgacgtggccgcccgctacctcgccgacggtgtgccgatcctggccgaggagcgtgtcgacatgcgccgcgagctcgcggccctggtggcccggtcaccgttcggacagggtgcggcgtggccggtggtcgagaccgtgcagcgcgacggcatctgcgtcgtggtgctggccccggcgccggagttgtccgacgacctgggctcgagcgcccagcagctggggttaaagctggccgccgaactcggcgtggtcggggtgctcgccgtcgagctcttcgagacggtcgacggccggctgctggtcaacgaattggcgatgcggccgcacaactccgggcactggagcatggacggcgcggtcaccggccagttcgaacagcacgtccgcgcggtgctggactatccgctcggcgacacctcgctgctcgccccggccaccgtgatggccaatgtcctcggggcgccgcagactccggcgatgacgatggacgaacgggtgcaccacctgttcgcccgcatgccggacgccaaggtgcacctgtacggcaagggggagcggcccggccgcaagatcggccacgtcaacctcaccggtgacgatccggcggtgttgcgtgagcgggccgagcgggccgcgcactggttgtcccacgccgagtggaccgacggatgggatccgcacgccgaagtcagggaaggaatctcgaggtga

SEQ ID NO: 13771 - protein, 411 aa, Mycobacterium sp. JLS
MPSHTPSTSSASSPPVVAMIGGGQLARMTHQAAIALGQTLRVLATGPQEPAAQVTPDVVIGSHTDLDALRRAAAGATVLTFDHEHVPTEALETLVAEGVNVAPPPAALVHAQDKLVMRRRLEAMGAPIPRYTAVDTVDDVVAFSSEVGGPVVLKTVRGGYDGRGVVLTADADEARDVAARYLADGVPILAEERVDMRRELAALVARSPFGQGAAWPVVETVQRDGICVVVLAPAPELSDDLGSSAQQLGLKLAAELGVVGVLAVELFETVDGRLLVNELAMRPHNSGHWSMDGAVTGQFEQHVRAVLDYPLGDTSLLAPATVMANVLGAPQTPAMTMDERVHHLFARMPDAKVHLYGKGERPGRKIGHVNLTGDDPAVLRERAERAAHWLSHAEWTDGWDPHAEVREGISR

SEQ ID NO: 13772 - DNA, 1191 bp, Prochlorococcus marinus str. MIT 9301
  CDS (1)..(1191): transl_table=11
atgagtttaaaaaaaaatataaacgattttaagaaaaattattccctgggaataattggaggtggtcaattggctttgatgttaaccgaggcagcaaaaaaaagagatcttgaagtatgtgtgcaaacaaaatcttgtgatgatcctgctgggttaaaagcagatcatgtcatagaagctgatcctttaaagataagaggtaataaatcattaattaatgagtgtgaaaaaataatttttgaaaatgaatggataaaaattgataaattaaatttaattgacaataaagatatttttgttccaagccttaatgcaattaagccattagtagataggttttctcaaaaaaaattaatagaaagaatgaatattccctgcccaaaatggataagtattgaagattttaaaaatctctcggatcaggaaatcaataattggacttttcctctaatggcaaaatcaaataaaggtggatatgacggcaaagggaacagaaaaataaagacaaaagaagatttagattcttttttaaaagagaacaattctaatgaatggttaatagaagaatggatagagtatgaaaaagaactggctcttgttggttcgagagataggaccggtaagataagattctttccaatagttgagacgttccaatcaaaccacgtttgtgattgggttcttgcccctggaacaaatgaatatgatttgaacttatttgcaataaatattttctcttcaatagtcaatgaacttaattacgttggagttttagctattgaattcttctatggagataatggtcttttaattaatgaaatagctcctagaacacataactcagctcatttctctattgaagcttgcacttcaagtcagtttgatcaatatgtttgcatttcttctgggataatgccacctgaaattaaaatgaactgtgaaggtgcaattatgataaatttactgggtttaaaaaagaatttcccaatctcaatggaaaccagaattaaaatgttatctgaaattgagggttctaatattcattgttatggcaaatctcgcgaaattctgggaagaaaaatggctcacatcacatttttattaaatggtaaaacgcatttagaaagatatgatgaagctcaaattttattaactatggtaagagacatttggccatctccaaatgcataa

SEQ ID NO: 13773 - protein, 396 aa, Prochlorococcus marinus str. MIT 9301
MSLKKNINDFKKNYSLGIIGGGQLALMLTEAAKKRDLEVCVQTKSCDDPAGLKADHVIEADPLKIRGNKSLINECEKIIFENEWIKIDKLNLIDNKDIFVPSLNAIKPLVDRFSQKKLIERMNIPCPKWISIEDFKNLSDQEINNWTFPLMAKSNKGGYDGKGNRKIKTKEDLDSFLKENNSNEWLIEEWIEYEKELALVGSRDRTGKIRFFPIVETFQSNHVCDWVLAPGTNEYDLNLFAINIFSSIVNELNYVGVLAIEFFYGDNGLLINEIAPRTHNSAHFSIEACTSSQFDQYVCISSGIMPPEIKMNCEGAIMINLLGLKKNFPISMETRIKMLSEIEGSNIHCYGKSREILGRKMAHITFLLNGKTHLERYDEAQILLTMVRDIWPSPNA

SEQ ID NO: 13774 - DNA, 1194 bp, Herminiimonas arsenicoxydans
  CDS (1)..(1194): transl_table=11
atgagcaagaatgaactttcccctttgaacccttccgcagccggaacctggctgggcgtgatgggcggtggtcagctgggccgcatgttcgcgcacgctgcgcagcaaatgggtttcaaggtggcagtactggaaccggcattcgattgtccggccggccatgccgccgatcaattgcatagcgccgactataccgatgtcgaagcgttgaccaagctggcatcgcaatgcgctgcagtgacgaccgaatttgaaaatgtgtcggcgaagagtctcgcattcctggccgagagtaccttcgttgcaccatcggcttcctgcgtttcgatcgcacaggatcgcatggcggaaaagcgtttcttcatcgaatgcgcgattacttccggagtcttcccggcctcgcacaaggaaatcaattctgctgccgatatcgatgccgtaccggacgatttattgccgggcatcttgaaaaccgtacgcatgggttacgacggcaagggccaggtgcgcgtcaagacgcgtgccgaattgcatgcagcatatggcggcatggatggcgtcgcctgcgtgctggaaaaaatgctgccgctggcctacgaaatttccgtattggcggcacgcggtgccgatggaaaggcagtggtgtatccgattgcagaaaacgtgcatcgagacggcatactgtttaccaccacggtgccgggtccgaacatcggcaagaaatctgccgagaaggcacaggcagcgacactggccgtgattgagcagatgggctatgtcggcgtgttgtgcatagaattttttgtactcacggacggttcgctggtcgtcaatgaaatggcgccgcgaccccataacagcggtcactacacgatagacgcctgcgtcaccagccagtttgcgcaacaggcacgtgcgatggcgcgcctgcccctgggcgacgtgcgtcagcattcggcggcagcgatgctgaatatcctgggcgacatctggtttgcaggcgattcggatgaggcacgcgaaccggcgtgggatcaggtgctggctttgccgggcgccaatctgcatttgtacgggaaagatactgcgcgtcgtgcacgaaaaatgggtcatatcactttcgtcgcagcgacggtggcagaagcgcaagccaatttgcgtcaggcctgcgccattctcggcatcaccgtttga

SEQ ID NO: 13775 - protein, 397 aa, Herminiimonas arsenicoxydans
MSKNELSPLNPSAAGTWLGVMGGGQLGRMFAHAAQQMGFKVAVLEPAFDCPAGHAADQLHSADYTDVEALTKLASQCAAVTTEFENVSAKSLAFLAESTFVAPSASCVSIAQDRMAEKRFFIECAITSGVFPASHKEINSAADIDAVPDDLLPGILKTVRMGYDGKGQVRVKTRAELHAAYGGMDGVACVLEKMLPLAYEISVLAARGADGKAVVYPIAENVHRDGILFTTTVPGPNIGKKSAEKAQAATLAVIEQMGYVGVLCIEFFVLTDGSLVVNEMAPRPHNSGHYTIDACVTSQFAQQARAMARLPLGDVRQHSAAAMLNILGDIWFAGDSDEAREPAWDQVLALPGANLHLYGKDTARRARKMGHITFVAATVAEAQANLRQACAILGITV

SEQ ID NO: 13776 - DNA, 1197 bp, Burkholderia vietnamiensis G4
  CDS (1)..(1197): transl_table=11
atgaccgcaactcctgattccgtttccccgatcctgcccggcgcgtggctgggcatggtcggcggcggccagctcggccgcatgttctgctttgccgcccagtcgatgggctatcgcgtcgccgtgctcgatcccgatccggcgagcccggccgggtcggtagccgaccgccatctgcgcgcggcctacgacgacgaagccgcgctcgccgagctggccgcgctgtgcgaagccgtgtcgacggaattcgagaacgtgccggccgcgagcctcgatttcctcgcgcgcacgacgttcgtcgcgccggccggccgctgcgtggcagtcgcgcaggaccgcatcgcggagaagcgtttcatcgaggcatccggcgtgccggtcgcgccgcacgtcgtgatcgagtcgccggccgcgctcgccgccctcgacgatgccgcgctcgatgcggtgctgcccggcatcctgaagaccgcgcggctcggctacgacggcaaggggcaggtgcgcgtgagcaccgcacgcgaagcgcgcgacgcgcacgcggcgctcggcggcgtgccgtgcgtgctcgaaaagcgcctgccgctgaaatacgaagtgtcggcgctgatcgcgcgcggcgtggacggccgctcggccgcgttcccgctcgcgcagaacgtgcatcacgacgggatcctcgcactgacggtggtgccggcgccggccgccgatgccgcgcgtgtcgaagaggcgcagcaggccgcgatccggatcgccgacaagctcgattacgtcggcgtgctgtgcgtcgaattcttcgtgctggaagacggctcgttcgtcgcgaacgaaatggcgccgcgcccgcacaactccggccactacacggtcgatgcgtgcgcaaccagccagttcgagcagcaggtgcgcgcgatgacgcgcatgccgctcggcaacccgcgccagcattcgccggccgcgatgctgaacatcctcggcgacgtgtggttcccgaacggcgccgatgccgagccggtcacgccgccgtgggacacggtcgcggcgatgccggccgcgcatctgcatctgtacggcaaggaagaggcgcgcgtcggccgcaagatgggtcacgtgaacttcacggccgagacgcgcgacgacgcggtcgcggccgccaacgcgtgtgcgcagctgctgcgcgtgccgctcgactga

SEQ ID NO: 13777 - protein, 398 aa, Burkholderia vietnamiensis G4
MTATPDSVSPILPGAWLGMVGGGQLGRMFCFAAQSMGYRVAVLDPDPASPAGSVADRHLRAAYDDEAALAELAALCEAVSTEFENVPAASLDFLARTTFVAPAGRCVAVAQDRIAEKRFIEASGVPVAPHVVIESPAALAALDDAALDAVLPGILKTARLGYDGKGQVRVSTAREARDAHAALGGVPCVLEKRLPLKYEVSALIARGVDGRSAAFPLAQNVHHDGILALTVVPAPAADAARVEEAQQAAIRIADKLDYVGVLCVEFFVLEDGSFVANEMAPRPHNSGHYTVDACATSQFEQQVRAMTRMPLGNPRQHSPAAMLNILGDVWFPNGADAEPVTPPWDTVAAMPAAHLHLYGKEEARVGRKMGHVNFTAETRDDAVAAANACAQLLRVPLD

SEQ ID NO: 13778 - DNA, 1074 bp, Streptococcus pyogenes str. Manfredo
  CDS (1)..(1074): transl_table=11
atgaactcatttaagactattgggattattggtggtggtcagctagggcagatgatggccattgcggccatctatatgggccacaaggtcatcacgctggatcctactaatgactgccctgcctcccgcgttagcgaggtaattgtggcgccttacgatgatgttgaggctttgggacaattggctgcgtgttgcgatgtgttgacttatgagtttgagaatgttaatgcggacggtttggatgccgttgtgtcagcttgtcagctaccgcaggggaccgatctgctccgcatttcccaaaaccgtatctttgaaaaagactttctggcaaataaggctggtgtgactgttgctccctataaggtggtgacgtctagccttgacctagaggggcttgattttaccaagacctatgtcctcaagacagcgacaggtggttatgacggtcatgggcaaaaggttatccgctcagcagaagatttgccagaggcgcagcaattagctaactcagctcagtgtgtcttggaagagtttgtcaactttgaccttgaaatctcagtcatcgtgtctggaaatggagaggatgtgacggtctttcccgttcaggaaaatatccactgcaacaatatcctgtcaaaaactatcgtgccagctcgtatctcagatcaactggctgataaggctaagaaaatggcggtgcagattgccaagaaactccagctgtcaggaactctctgtgtggaaatgtttgcgaccgcagatgatatcattatcaatgaaattgccccacgtccccacaactcagggcactactcaatcgaggcttgcgacttttcacagtttgacacccacattttgggcgtactcgggcaacctctcccaccaatcaaactccatgctccagccgtcatgcttaatgtcctcggacaacacgtccagcaggcaattgactatgttgcccaaaaccctagcgcccacctccacatgtatggtaaactagaagcgaaacataaccgcaaaatgggacatgtgacactatttgcagaagatgcagatgaggtggaggagttttag

SEQ ID NO: 13779 - protein, 357 aa, Streptococcus pyogenes str. Manfredo
MNSFKTIGIIGGGQLGQMMAIAAIYMGHKVITLDPTNDCPASRVSEVIVAPYDDVEALGQLAACCDVLTYEFENVNADGLDAVVSACQLPQGTDLLRISQNRIFEKDFLANKAGVTVAPYKVVTSSLDLEGLDFTKTYVLKTATGGYDGHGQKVIRSAEDLPEAQQLANSAQCVLEEFVNFDLEISVIVSGNGEDVTVFPVQENIHCNNILSKTIVPARISDQLADKAKKMAVQIAKKLQLSGTLCVEMFATADDIIINEIAPRPHNSGHYSIEACDFSQFDTHILGVLGQPLPPIKLHAPAVMLNVLGQHVQQAIDYVAQNPSAHLHMYGKLEAKHNRKMGHVTLFAEDADEVEEF

SEQ ID NO: 13780 - DNA, 1110 bp, Bradyrhizobium sp. ORS278
  CDS (1)..(1110): transl_table=11
gtgaccggctccaatcgggtgaagctcaagcccggggacaccatcggcattctcggcggcggccagctcggccgcatgctggcgttggcggccgcgcggctcggactgcgttgccaggtgttctcgcccgaccctgactcgccggcctttgacgtggtcctgaacgccacctgcgccgaatatgcggacgtcgaggcgctggaattgttcgcgaacgacgtcgacgtcgtcacctacgagttcgaaaacgtcccgtcggcggcggcgctggtcctggccgcacgacgtcccgtgctgcccagccgctccgcgctggagaccacccaggaccgactgacggaaaaggatttcgtcacctcgctgggcatccacaccgccaattacgccgacgtctcgtcggtcggcacattgcgagaggccatcctgcgcatcggcctgccggccgtgctgaaaacccgccgcttcggctacgacggcaagggtcaggtcaagatccgccagggcgacgacctcgaacggatctgggccgagctcggcaccaaatccgccatcctcgaggccttcgtgcccttcgagcgcgagatctccgtagtggctgcgcgtgccgccgatggccaggtcgaatgcttcgacgtcaccgagaacgagcatcgcgatcacattctcaaggtgtcgcgggcacccgcttccattccggacgcgctcgctgacgaggcccgggacatcgccagccggatcgcgacggcactggactatgtgggggtcctcgcggtggagatgttcgtcgtgaccgctgggcctaaacccggcgtggttgtcaacgagattgcgccacgggtgcacaattccggccattggacgctcgacggcgcgtccatctcgcagttcgaacagcacatccgggcgatcgctggctggcctctcggcaaaccagtgcgccatggccatgtcacgatgaccaatctgatcggcgatgagatcgacagctatgagcagtggctgaccgttcccggagcgaccgttcacctctatggcaagggcgccccccgcccgggccgcaagatgggccatgtgacgcaggtctcgccgctcccgccccggatgggctga

SEQ ID NO: 13781 - protein, 369 aa, Bradyrhizobium sp. ORS278
MTGSNRVKLKPGDTIGILGGGQLGRMLALAAARLGLRCQVFSPDPDSPAFDVVLNATCAEYADVEALELFANDVDVVTYEFENVPSAAALVLAARRPVLPSRSALETTQDRLTEKDFVTSLGIHTANYADVSSVGTLREAILRIGLPAVLKTRRFGYDGKGQVKIRQGDDLERIWAELGTKSAILEAFVPFEREISVVAARAADGQVECFDVTENEHRDHILKVSRAPASIPDALADEARDIASRIATALDYVGVLAVEMFVVTAGPKPGVVVNEIAPRVHNSGHWTLDGASISQFEQHIRAIAGWPLGKPVRHGHVTMTNLIGDEIDSYEQWLTVPGATVHLYGKGAPRPGRKMGHVTQVSPLPPRMG

SEQ ID NO: 13782 - DNA, 1128 bp, Dichelobacter nodosus VCS1703A
  CDS (1)..(1128): transl_table=11
atgaaaataggattactgggcggcggacaattaggacgcatgtttttacaagcagcggcaaattatccatttacaattaaagtgttagatccccaagcggacgcgccgtgtgcgcatttatgcgatgaattcgtgcaaggtgattttcgtgatgaagaaacggtggtcgcttttggtacggattgcgacgtgatcggcattgaaattgaacacgtcagcgtcgccggtttacgccgtttgcaagcgatgggcaaaaaagtgctgcccgatccggaaatattagccatcattcaagataaaggcgtacaaaaacaattttacgaacgccatcatttaccgaccgcgcctttttatttaattgaacgtaaaacagacatcgatttaaaccgcattccgcttccttttgtgcaaaaaacgcgtaccggcggttacgacggcaaaggcgtgcaaatcatatgccggcaggaagatttagctcaattgtgggacgttccctcagtgattgaagctttatgtcctattgcgcaggaaattgcggtgatcgtgttgcgcgatgaaaaaggcagcacaaaagcttatccggcagtagaaatggtttttgatccacaattaaatctggttgacgtagtacgcatgccagcaatgatcgcgcctcatttattaaaagaagccgaacgattggcgttaacgctcgccgatgcttttgcgcacagcggcatttatgcagtggaaatgtttgtcaccaaacacggcgccgtgtggctcaacgaaaccgcctgccgcgtacacaacagcggtcatttaactattgaagcctgttatcactcacaattcgatcaattatggcgtttgctggcaggacaacctttggcatcggttgcgcaacatacgcccgccgcgatgattaacattgttggcgcggaacatcattgtggacgcgcaaaaatggcgcatttgcacgaacttttagcgttagaacacgtttttgtgcattggtacggcaaaacgcaaacgcgcgccggacgcaaaatgggacacgttaccatcgtggcaaaagacagcgccgccgttgatgagaaagtggtcgccgttaaaaaatttgtcgatgttattgcagaaaaggaataa

SEQ ID NO: 13783 - protein, 375 aa, Dichelobacter nodosus VCS1703A
MKIGLLGGGQLGRMFLQAAANYPFTIKVLDPQADAPCAHLCDEFVQGDFRDEETVVAFGTDCDVIGIEIEHVSVAGLRRLQAMGKKVLPDPEILAIIQDKGVQKQFYERHHLPTAPFYLIERKTDIDLNRIPLPFVQKTRTGGYDGKGVQIICRQEDLAQLWDVPSVIEALCPIAQEIAVIVLRDEKGSTKAYPAVEMVFDPQLNLVDVVRMPAMIAPHLLKEAERLALTLADAFAHSGIYAVEMFVTKHGAVWLNETACRVHNSGHLTIEACYHSQFDQLWRLLAGQPLASVAQHTPAAMINIVGAEHHCGRAKMAHLHELLALEHVFVHWYGKTQTRAGRKMGHVTIVAKDSAAVDEKVVAVKKFVDVIAEKE

SEQ ID NO: 13784 - DNA, 1236 bp, Synechococcus sp. WH 7803
  CDS (1)..(1236): transl_table=11
atgctgctgtctgatctccgctcggatggcaagcttcaggttgaggacgaggctgacatggggagcgctgacggcgcaatcggtgtgatcggtggcgggcagttggctcggatgctgtcggaggcggctgctctccgcggcattgatgtgttggttcaaacctcatccgaagcggattgcgctgtgcctgcatccacccgatgggtgcaggccttacccaccgatcaggatgcgacgcgagaccttgcccgtgattgcggcggcatcaccttcgagaacgagtgggtgacggtggacgcgctgatgcctttggaacgccagggcgtgaccttcgtgccctccctggccagcctggttcccctcgttaacaaactgtcccagcgacgcctgctcgacgatctttccattcccagtccccgctggatctgtctggccgagatcaatccaggatcaccagcgctgcctcctggttggaccttcccggtgatggccaaagccgcatccggtgggtacgacgggaagggcacgcgcatccttgaaaatctcaatgatctggcccatcacctgcgcaatgtgcgtgctcaggattggttgctggagagttgggtgaactttgagcgggagctcgctcttgtggtgagtcgtgatcgacaggggcgaatccgccatttaccgctggtggaaacccatcagagtcatcaaatctgcgactgggttcttgcccctgcggaagcggagcccttgctcgaggcaaccgcttacaacatcgcagcctctttgctcacgcgccttggatacgtgggtgtgatggctctggagttcttctacggccaggaggggttgttcgtgaacgaaatcgctccacgcacccataactcgggtcacttttccatcgaagcctgctccagcagtcagttcgaccagcagctgtgcatcacggcagggttgccggtgccctccacagaactcgtggtggacggtgccttgatggtgaacctcctggggttgcaggacgctgctgccgatggccatgaccacaatctccaggatcgacttgcccggcttcggtcgattgccaatgcccacgtgcactggtacggcaagcaggaacttcccggtcgcaaagttgggcacgtcacggttgtgttgcgcgaagagcacgccgagacccgtcgacagatggcgatgacagcgttgaatcaaattcgtgaggtgtggccgaatcccctaaattga

SEQ ID NO: 13785 - protein, 411 aa, Synechococcus sp. WH 7803
MLLSDLRSDGKLQVEDEADMGSADGAIGVIGGGQLARMLSEAAALRGIDVLVQTSSEADCAVPASTRWVQALPTDQDATRDLARDCGGITFENEWVTVDALMPLERQGVTFVPSLASLVPLVNKLSQRRLLDDLSIPSPRWICLAEINPGSPALPPGWTFPVMAKAASGGYDGKGTRILENLNDLAHHLRNVRAQDWLLESWVNFERELALVVSRDRQGRIRHLPLVETHQSHQICDWVLAPAEAEPLLEATAYNIAASLLTRLGYVGVMALEFFYGQEGLFVNEIAPRTHNSGHFSIEACSSSQFDQQLCITAGLPVPSTELVVDGALMVNLLGLQDAAADGHDHNLQDRLARLRSIANAHVHWYGKQELPGRKVGHVTVVLREEHAETRRQMAMTALNQIREVWPNPLN

SEQ ID NO: 13786 - DNA, 1131 bp, Leptospira interrogans serovar Copenhageni str. Fiocruz L1-130
  CDS (1)..(1131): transl_table=11
gtgaacaattctcgaatgcttcttccaggttccaggctgggagtgatgggatcaggacaactcgcgagaatgttttgtttagaagcgattccttttggttacgagatttccgtttattctcccgaaaaaaattctccggccgcaggagcgggagcaaaagaatatatatccacttacgaagacgaaaaagctctgactttttttttggaaaatatagacggtcttacatttgaatttgagaatattccagaaattgcacttactacaatagaaaatttttctaaacgaaccggactgatagttagaccttctccgaactgcgtcagaatttcacaaaatcgctggaaggaaaaaacttcttttcaaaaagcaggaattcctacggtgaaattttatccggttttaacggaagaagacaaaaaatccgttctttctaagactaattttccctgtatcttaaaaacgaatacgatgggttacgacggtagggggcagattcggtgtatcaccgaacaagaactatctttagtattttctaacctcaacaaaccggatcatatcgtagaagaatttttccaatttacttcggaagcctccgttattatggccagatttgaagacggcaaaattttaaattttagaccttctaaaaacgttcataaaaatcatatcttggaccttacattttatcccggaaattttccagatagtatagaaactaaacttgtaaactatgcaaaaaaattagcggaaacaatcgattacgttggagtttttgggatagagttttttatccgaggagacgaaattttatgcaacgaatttgcacctaggccgcataactcaggacattttagtcaaaactctggtacaatttctcaattttcccttcagctgagaactctttgtaacttaccttccccaaaaacaatcctggccaacccagtatcaatgaaaaatattttaggagaagattataaacccggatctactctttggaataaaacattagaaaatccttattatcatcttcatctttatggcaaaacagaaattcgaaacggaagaaagatgggacactggaattactccggccccaacatagaatctgcttttttaaactgggactaa

SEQ ID NO: 13787 - protein, 376 aa, Leptospira interrogans serovar Copenhageni str. Fiocruz L1-130
MNNSRMLLPGSRLGVMGSGQLARMFCLEAIPFGYEISVYSPEKNSPAAGAGAKEYISTYEDEKALTFFLENIDGLTFEFENIPEIALTTIENFSKRTGLIVRPSPNCVRISQNRWKEKTSFQKAGIPTVKFYPVLTEEDKKSVLSKTNFPCILKTNTMGYDGRGQIRCITEQELSLVFSNLNKPDHIVEEFFQFTSEASVIMARFEDGKILNFRPSKNVHKNHILDLTFYPGNFPDSIETKLVNYAKKLAETIDYVGVFGIEFFIRGDEILCNEFAPRPHNSGHFSQNSGTISQFSLQLRTLCNLPSPKTILANPVSMKNILGEDYKPGSTLWNKTLENPYYHLHLYGKTEIRNGRKMGHWNYSGPNIESAFLNWD

SEQ ID NO: 13788 - DNA, 1110 bp, Thermus thermophilus HB27
  CDS (1)..(1110): transl_table=11
gtgatcgggatcctgggcggggggcaactcgggcggatgctggcccttgccggctaccccttggggctttccttccgcttcctggacccttcccccgaggcctgcgccgggcaggtgggggagctcgtggtgggggagtttctggacgaaggggcccttttgcgcttcgccgaggggcttgccctcgtcacctacgagtttgagaacgtccccgtggaggcggcgaggcgcctggaagggaggcttcccctctaccccccggcgaaggccctcgagggggcccaggaccgcctccgggaaaagaccttcttccagggcctcggcgtgcccacccctcccttccaccccgtggacggccccgaggacctggaggagggcctaaagcgggtaggccttcccgccctcctcaagacgaggcggggcggctacgacggcaaggggcaggccctggtgcgcacggaggaagaggccctagaggctctgaaggccctggggggcagggggcttattctggagggcttcgtcccctttgaccgggaagtctccctgctcgccgtccggggccggacgggggaggtggccttctatcccctggtggaaaaccgccaccggggagggatcctcaggctctccctggccccggcccccggggcctcggaggccctgcagaagaaggcggaggcctacgccttgagggccatggaggccctggactacgtgggcgtcctcgccctggagttcttccaggtgggggaggaactcctcttcaacgagatggccccccgggtgcacaactccggccactggacgatagaaggagcggagacgagccagtttgagaaccacctccgggccgtcctgggccttcccctggggagcaccgcccccaggggccaaagcgccatggtgaacctcatcggggaaaagccccccttcgccgaggtcctaaaggtagagggggcccacctccactggtacggcaaggcggtgcgccccgggcgcaaggtggggcacatcaccctgaggcgggacggcctagaggccctggaggaaggcctcgcgcggctttcgcgcctggtctccgagcttccctgggagggacgcgtatga

SEQ ID NO: 13789 - protein, 369 aa, Thermus thermophilus HB27
MIGILGGGQLGRMLALAGYPLGLSFRFLDPSPEACAGQVGELVVGEFLDEGALLRFAEGLALVTYEFENVPVEAARRLEGRLPLYPPAKALEGAQDRLREKTFFQGLGVPTPPFHPVDGPEDLEEGLKRVGLPALLKTRRGGYDGKGQALVRTEEEALEALKALGGRGLILEGFVPFDREVSLLAVRGRTGEVAFYPLVENRHRGGILRLSLAPAPGASEALQKKAEAYALRAMEALDYVGVLALEFFQVGEELLFNEMAPRVHNSGHWTIEGAETSQFENHLRAVLGLPLGSTAPRGQSAMVNLIGEKPPFAEVLKVEGAHLHWYGKAVRPGRKVGHITLRRDGLEALEEGLARLSRLVSELPWEGRV

SEQ ID NO: 13790 - DNA, 1134 bp, Listeria monocytogenes str. 4b F2365
  CDS (1)..(1134): transl_table=11
gtgattatcttggataaaaaatttttactgacaaatagtactattggtattattggtggcggacaacttggacgtatgcttgctcttgcggcgaaagcgatggggtatcgtattattgttcttgatcctaccgctgattgcccagctgctcaagtaagtgatgaacaaattattgctgactatgatgataaagtagcattacgcgaactttccgaaaaagcagatgtagttacatatgaatttgaaaatatcgactatgatgctttgaaaatgacgcaaaacttagtatctgtcccgcaaggatcggaattgctttcgattacacaggataggattttggaaaaagcttatctggaatcagctaatattaacattgcgccgtatgcggttatagtggaacaagatgaaattgaaaatgaaattaaaagtattggatatcctgctgttttaaaaacggcacaaggtggatacgacgggaaagggcaagtggttattcatgatgcaagggatattgaaacagcagcgagattgttgcgatacggctcttgtgtactagaagcttggattccttttgaaaaagagatttctgtggttgtcgctcgtaatttagatgggcaaatagaaacttttccagttgcagaaaatgtacatgtaaataatattttgcatacaactacggctcctgcagatgtggcggatgacgtgcatgaggaagcggaagaaattgcgagaaagttagcagatgtacttcaattatgtggtgttttagcagtagaaatgtttgtgacaaaatcaggggctatttatgtaaatgaacttgctccaagacctcataattctgggcattttacaattgaagcttgttctatttctcagtttacgcagcatattcgagcgattgttggattgccacttgtaaaaccagaactcttaaaaccagccttaatgattaatattttagggcaacatgtcgatgcagtgaataaacaaatggtgaattatccacattggtttgtacattattatggaaaaaaagaagcgaaaatcaatcgcaaaatgggtcatgttactgtgcttgctgatgaaccaaaagcggttatacaagatttagaagaaacgcaaatttggaagtaa

SEQ ID NO: 13791 - protein, 377 aa, Listeria monocytogenes str. 4b F2365
MIILDKKFLLTNSTIGIIGGGQLGRMLALAAKAMGYRIIVLDPTADCPAAQVSDEQIIADYDDKVALRELSEKADVVTYEFENIDYDALKMTQNLVSVPQGSELLSITQDRILEKAYLESANINIAPYAVIVEQDEIENEIKSIGYPAVLKTAQGGYDGKGQVVIHDARDIETAARLLRYGSCVLEAWIPFEKEISVVVARNLDGQIETFPVAENVHVNNILHTTTAPADVADDVHEEAEEIARKLADVLQLCGVLAVEMFVTKSGAIYVNELAPRPHNSGHFTIEACSISQFTQHIRAIVGLPLVKPELLKPALMINILGQHVDAVNKQMVNYPHWFVHYYGKKEAKINRKMGHVTVLADEPKAVIQDLEETQIWK

SEQ ID NO: 13792 - DNA, 1086 bp, Picrophilus torridus DSM 9790
  CDS (1)..(1086): transl_table=11
atgaagataggcattattggttcaggtcagcttggctggatgatgatgctcgaatcatataacttgccggttgatttttacatgctcgacaatgagccgggaccggcatcatacatggcaagaaaatttttcacgcccgataaatacaaagaatttgttgattcatgtgattatattacatatgaattcgagcacgttgatggcagaacgctggaatattcagagaaatcaaataaattaagacctggccttaaggcaatagaaataaagagggaccgctcacttgaaaaggactttttaagatctataaacgttccagaggctgattatgaaaaggcagataattttaatgaagcattgaagatggccagggacaagggcaatgctgtgataaagacctgtgccggtggctacgatgggaagggtcaattctacgttcatgattctgatacatccaaattcgaggggcttgatgttccgggaagatttattgtcgaggattttataaactatgaaagtgaggcctcgataattgctgtaagatcagaatcaggtgaatttcaattctttgacccgtcctttaattacaacaaaaacggcatcctgatttataacattgcgccttttaatgataaaaaatcagagatgcaggaaattgcaaaaaagatcatgaacaatttaaattacataggtgtaatgggcatagaattctacattgtaaataataaggttcttgtaaatgagatcgccccaagggttcataatactggtcatcacacattaaagggaagctcgatatcacagtttcaggagcatataagggcaatatcaaatatgaatataatcaggccagagctttacaaaccatccggtatagttaacatacttggccggggtatagatgatgtttacaatgaaataatgaaaactgccgatgatgtttactggtacagaaaaccggagataagaagaaagagaaagatggggcatgttaatataacaggtgaaagctatagtgatgttaataaccgtgtaaacgatgtgctaaacattctttataggggcaatctggatcagtttatataa

SEQ ID NO: 13793 - protein, 361 aa, Picrophilus torridus DSM 9790
MKIGIIGSGQLGWMMMLESYNLPVDFYMLDNEPGPASYMARKFFTPDKYKEFVDSCDYITYEFEHVDGRTLEYSEKSNKLRPGLKAIEIKRDRSLEKDFLRSINVPEADYEKADNFNEALKMARDKGNAVIKTCAGGYDGKGQFYVHDSDTSKFEGLDVPGRFIVEDFINYESEASIIAVRSESGEFQFFDPSFNYNKNGILIYNIAPFNDKKSEMQEIAKKIMNNLNYIGVMGIEFYIVNNKVLVNEIAPRVHNTGHHTLKGSSISQFQEHIRAISNMNIIRPELYKPSGIVNILGRGIDDVYNEIMKTADDVYWYRKPEIRRKRKMGHVNITGESYSDVNNRVNDVLNILYRGNLDQFI

SEQ ID NO: 13794 - DNA, 1152 bp, Bacillus anthracis str. Sterne
  CDS (1)..(1152): transl_table=11
atgacgagaatcattttacctggaaaaacaatcggcattattggaggcggccagctaggaagaatgatggcattggcagctaaggaaatgggatataaaattgctgttttagatcctacaaaaaactcaccatgtgcacaagttgctgatattgaaattgttgcatcatatgacgatttaaaagcaattcagcatttagcagagatcagtgatgttgtcacatatgaatttgagaatattgattatagatgtttacaatggcttgaaaaacatgcttacttaccgcaaggcagtcagttgttaagtaaaacgcaaaatcgttttacagaaaaaaatgcaatagaaaaagcgggattaccagtagcaacgtatagattggttcaaaatcaagagcagcttactgaagcaatcgctgagttatcatatccttccgtcttaaaaacaacgacaggtggatatgatgggaaagggcaagttgttttaagaagtgaagctgacgttgatgaagcgcgaaagcttgcgaatgcagcagagtgtattttagagaaatgggtgccttttgaaaaagaagtatcagttatcgtaattcgtagtgtaagtggtgaaacgaaagtatttccggtagcggaaaatattcatgtaaataacattttgcatgaatccatcgttccagctcgcattacagaagaactttctcaaaaagcaattgcttatgcaaaagtgctagcggatgaactagaacttgtgggaacactagcggtagagatgtttgctacagccgatggtgagatttacattaatgaattggcgccaagacctcacaattcaggacactatacacaggatgcatgtgaaacgagtcaattcggtcaacatattcgagcaatctgtaatttacctcttggagaaacaaatttgttaaaaccagttgtcatggtaaacattttaggcgaacatatagaaggggtcctaagacaagtgaatagattaaccgggtgctatttacacttgtatggaaaagaagaagcaaaagcgcagcgaaaaatggggcatgttaatattttaaatgataatattgaagtcgctctagaaaaagcaaagagtttgcatatttgggaccatcaagaacaactgttggagggaaaaagatga

SEQ ID NO: 13795 - protein, 383 aa, Bacillus anthracis str. Sterne
MTRIILPGKTIGIIGGGQLGRMMALAAKEMGYKIAVLDPTKNSPCAQVADIEIVASYDDLKAIQHLAEISDVVTYEFENIDYRCLQWLEKHAYLPQGSQLLSKTQNRFTEKNAIEKAGLPVATYRLVQNQEQLTEAIAELSYPSVLKTTTGGYDGKGQVVLRSEADVDEARKLANAAECILEKWVPFEKEVSVIVIRSVSGETKVFPVAENIHVNNILHESIVPARITEELSQKAIAYAKVLADELELVGTLAVEMFATADGEIYINELAPRPHNSGHYTQDACETSQFGQHIRAICNLPLGETNLLKPVVMVNILGEHIEGVLRQVNRLTGCYLHLYGKEEAKAQRKMGHVNILNDNIEVALEKAKSLHIWDHQEQLLEGKR

SEQ ID NO: 13796 - DNA, 1179 bp, Bartonella quintana str. Toulouse
  CDS (1)..(1179): transl_table=11
atgacagactcttccaacattttgccttctcccagtgcctccttcttgcccagcacatcctcctcacccaatgcaacgccttccactaacattctccctttgggaagcgtgatcggtttaataggcggaggacagttggcacgtatgttagccatagcggcagcagaactaggatttcgaactgttgttttttgccctgaaccggattgcccagcagcacaaacaacgaacgaccatattgtttcaccctatgatgattattcagcattagatcattttatttctctgtgtgatgttgttacttatgagtttgaaaatctttcccttcaaacggttcaatatatagagagaaccaagcatgtttatccttcctccaaggctttagagattacgcaagatcggctttttgagaagcaatttttgcaggaaataggtatccgcacggcattgtggcatgctgttgataatcattcttctctgcttttgggactttctgcattaggtggtcgtggtcttttgaaaacccgccgttttggctatgatggaaaaaatcagatgatgctaaatcatccgaaggaagaagccatagaggaagccttcacgatttttgagggacagccgtcgattttggaagagattgttccttttttatcggagatttcggttctctcggcacgcacaaagcaagggaaccatattttttatgattgccctgaaaatcagcataaaaacggcattcttcacaaatcatttgttccatcgcgtgttccgctttcggtgcagaaggctgcgcaagaaataagcgtaacagttatggacgctctgaattatgttggtgttctttgcattgaattttttgtcttaatggatggtacccttttagtgaatgaattggcacctcgtgtccacaactctggtcattggacgcaaaaagcgtgcgtcacttcacaatttgaacagcatatccgcgccctatgcgggcttcctttgggcagcacataccgtcacagcaattgcgagatgatcaatcttcttggcagcaatctcaacgatttcaaatattttctgacgcaagagcgcacatcggttcatttatatggcaaaaaccctgttcggtcgacccgcaaaatggggcatgtcatccaattaacgggcccagtcaccaaatctgaacagtga

SEQ ID NO: 13797 - protein, 392 aa, Bartonella quintana str. Toulouse
MTDSSNILPSPSASFLPSTSSSPNATPSTNILPLGSVIGLIGGGQLARMLAIAAAELGFRTVVFCPEPDCPAAQTTNDHIVSPYDDYSALDHFISLCDVVTYEFENLSLQTVQYIERTKHVYPSSKALEITQDRLFEKQFLQEIGIRTALWHAVDNHSSLLLGLSALGGRGLLKTRRFGYDGKNQMMLNHPKEEAIEEAFTIFEGQPSILEEIVPFLSEISVLSARTKQGNHIFYDCPENQHKNGILHKSFVPSRVPLSVQKAAQEISVTVMDALNYVGVLCIEFFVLMDGTLLVNELAPRVHNSGHWTQKACVTSQFEQHIRALCGLPLGSTYRHSNCEMINLLGSNLNDFKYFLTQERTSVHLYGKNPVRSTRKMGHVIQLTGPVTKSEQ

SEQ ID NO: 13798 - DNA, 1251 bp, Bartonella henselae str. Houston-1
  CDS (1)..(1251): transl_table=11
atgacagactcttctaacattctgctttcacccagcatatccgcttcatccagcatatccccttcacccaacgcatccccctcatccagcgcatccgcttcatccagcatatccgcttcacccagcatatccgcttcatccagcatatccccttcacccagcattcttccttcaggaagcgtgatcggtttaataggtggaggacagttggcgcgcatgttagccatagcggcagcagaactaggatttcgaacagttgttttttgccctgaaacggattgtccagcatcacaaacaacaaacgatcatattgtttcaccctatgatgatgactcagccttagatcgttttatatctctgtgtgatgttataacctatgagtttgaaaatctttcccttcaaatgattcaatatgtagagaaaagcaagccggtttatccctcttcgaaggcattagagtttacacaagatcggctttttgagaagcaatttttgcaagagcaagggatcaaaacggcattatggcatgctgttgatgatatgtcttctctagtctcaggactttccaagttaggcggtcgtggtcttttgaagacacgacgttttggctatgatggaaaaaatcagatgatgcttaatcatcccaatgaagaaaccctagagaaagcattcacggcttttaaggaacaggcatcgattttggaagaaattgttccttttttatcggagatttctgttctctcggcacgcacgaaacaaggggaacatattttttatgattgccctgaaaatcagcatcaaaacggcattcttcacaaatcatttgttccatcccgtattccgctttcggtgcaaaaggcagcgcaagaaataagtgcaacggttatggatgccttgaattatgtaggtgttctttgcattgaattttttgtcttaatggatgggagccttttagtaaatgaattagcgcctcgtgttcataactctggccactggacgcaaaaggcgtgcgtaacttcacagtttgaacaacatatccgtgccatttgcggtcttcctttggggagcacataccggcacagcaattgcgagatgaccaatcttcttggcagcaatctgcaagatttcaaatattatctcacacaagagcgcacatcggtccatttatatggcaaaagccttttgcaaccgacacgcaaaatggggcatgtcatccaattaacgggaccagtgactaaatacaaacagtaa

SEQ ID NO: 13799 - protein, 416 aa, Bartonella henselae str. Houston-1
MTDSSNILLSPSISASSSISPSPNASPSSSASASSSISASPSISASSSISPSPSILPSGSVIGLIGGGQLARMLAIAAAELGFRTVVFCPETDCPASQTTNDHIVSPYDDDSALDRFISLCDVITYEFENLSLQMIQYVEKSKPVYPSSKALEFTQDRLFEKQFLQEQGIKTALWHAVDDMSSLVSGLSKLGGRGLLKTRRFGYDGKNQMMLNHPNEETLEKAFTAFKEQASILEEIVPFLSEISVLSARTKQGEHIFYDCPENQHQNGILHKSFVPSRIPLSVQKAAQEISATVMDALNYVGVLCIEFFVLMDGSLLVNELAPRVHNSGHWTQKACVTSQFEQHIRAICGLPLGSTYRHSNCEMTNLLGSNLQDFKYYLTQERTSVHLYGKSLLQPTRKMGHVIQLTGPVTKYKQ

SEQ ID NO: 13800 - DNA, 1152 bp, Bacillus thuringiensis serovar konkukian str. 97-27
  CDS (1)..(1152): transl_table=11
atgacaagaatcattttacctggaaaaacaatcggtattattggaggcggccagctaggaagaatgatggcattggtagctaaggaaatgggatataaaattgctgttttagatcctacaaaacattcaccatgtgcacaagttgctgatattgaaattgttgcatcatatgacgatttaaaagcaattcagcatttagcagaaatcagtgatgttgtcacatatgaatttgagaatattgattatagatgtttacaatggcttgaaaaacatgcttacttaccgcaaggcagtcagttgttaagtaaaacgcaaaatcgttttacagaaaagaatgcaatagaaaaagcgggattaccagtagcaacgtatagattggttcaaaatcaagagcagcttactgaagcaatcaccgagttatcatatccttccgtcttaaaaacaacgacaggtggatatgatgggaaagggcaagttgttttaagaagtgaagctgacgttgatgaagcgcgaaagcttgcaaatgcagcagagtgtattttagagaaatgggtgccttttgaaaaagaagtatcagttatcgtaattcgtagtgtgagtggtgaaacgaaagtatttccggtagcggaaaatattcatgtaaataacattttgcatgaatccatcgttccagctcgcattacagaagaactttctcaaaaagcaattgcttatgcaaaagtgctagcggatgaactagaacttgtgggaacactagcggtagagatgtttgctacagccgatggtgagatttacattaatgaattggcgccaagacctcacaattcaggacactatacacaggatgcatgtgaaacgagtcaattcggtcaacatattcgagcaatctgtaatttacctcttggagaaacaaatttgttaaaaccagttgtcatggtaaacattttaggcgaacatatagaaggggtcctaagacaagtgaatagattaaccgggtgctatttacacttgtatggaaaagaagaagcaaaagcgcagcgaaaaatggggcatgttaatattttaaatgataatattgaagtcgctctagaaaaagcaaagagtttgcatatttgggaccatcaagaacaactgttggagggaaaaagatga

SEQ ID NO: 13801 - protein, 383 aa, Bacillus thuringiensis serovar konkukian str. 97-27
MTRIILPGKTIGIIGGGQLGRMMALVAKEMGYKIAVLDPTKHSPCAQVADIEIVASYDDLKAIQHLAEISDVVTYEFENIDYRCLQWLEKHAYLPQGSQLLSKTQNRFTEKNAIEKAGLPVATYRLVQNQEQLTEAITELSYPSVLKTTTGGYDGKGQVVLRSEADVDEARKLANAAECILEKWVPFEKEVSVIVIRSVSGETKVFPVAENIHVNNILHESIVPARITEELSQKAIAYAKVLADELELVGTLAVEMFATADGEIYINELAPRPHNSGHYTQDACETSQFGQHIRAICNLPLGETNLLKPVVMVNILGEHIEGVLRQVNRLTGCYLHLYGKEEAKAQRKMGHVNILNDNIEVALEKAKSLHIWDHQEQLLEGKR

SEQ ID NO: 13802 - DNA, 1152 bp, Acinetobacter sp. ADP1
  CDS (1)..(1152): transl_table=11
gtgctgagtgaaaatatgatgatgaaacaaatcaataagattggaatttttggtggcggtcagcttggacgcatgatggcacaagctgcgttgccactgaatattcaatgtactttttttgaagcaaatacagactgtcctgcggctattttaggtcaggtattttcaggccagaatgatgcagaagcgcttcaggcatttattcaaagtgctgaggtttttagtcttgaatttgaaaatacgccattggcagatgttgatgtccttgcacagcaaaaagcgatctttccgccgcgtcaagctttggcaactgcgcaaaatcgtttgctggaaaaagaactttttcggcatcttgatattccagttgcgccgtttcaggcagttgatagcctggaatccttgaaagaggctgtacacatactcggtcttccaattgttctgaaaactgcaacaggcggttatgatggaaaaggtcagtttgtactgcgtgaagcggagcaaattgatcaggcttggcaagagcttggccctgccaaatcgctgattgcagagagctttgtgaaattctcaagagaggtttcgattattgcagtgcgtggtcaagatggcgaagttaaaacttggccgttggcagaaaatcatcatcatcatgggattttatcgcattcgattgtacctgcgccgcatagcgaagatttgcaacctgttgcacaagattatattacccgcctgctcaatcatttgaattatgtgggtgtattgaccttagagctttttgtaacagaacaaggcttgtttgccaatgaaatggcgccaagagtacataactcaggacattggtcaattgagggtgcggtatgttcgcagtttgaaaaccatgttcgtgccgtggccggtttacctttgggttctactgaggttatacgcccaaccgtcatgattaacattataggcaagcatccaaaatcagaagatgttttagcgctcaatggtgcacatttgcatttgtacaataagactgagcgtgacggtcgtaagcttggtcatatcacattgatgcctttgaaccgtagtgaactgacttcactatgtcgtcagttggctgacattttgccagagcctctagcattgactcaagacatgaacatctaa

SEQ ID NO: 13803 - protein, 383 aa, Acinetobacter sp. ADP1
MLSENMMMKQINKIGIFGGGQLGRMMAQAALPLNIQCTFFEANTDCPAAILGQVFSGQNDAEALQAFIQSAEVFSLEFENTPLADVDVLAQQKAIFPPRQALATAQNRLLEKELFRHLDIPVAPFQAVDSLESLKEAVHILGLPIVLKTATGGYDGKGQFVLREAEQIDQAWQELGPAKSLIAESFVKFSREVSIIAVRGQDGEVKTWPLAENHHHHGILSHSIVPAPHSEDLQPVAQDYITRLLNHLNYVGVLTLELFVTEQGLFANEMAPRVHNSGHWSIEGAVCSQFENHVRAVAGLPLGSTEVIRPTVMINIIGKHPKSEDVLALNGAHLHLYNKTERDGRKLGHITLMPLNRSELTSLCRQLADILPEPLALTQDMNI

SEQ ID NO: 13804 - DNA, 1071 bp, Erwinia carotovora subsp. atroseptica SCRI1043
  CDS (1)..(1071): transl_table=11
atgaaaccagtttgcgtattaggcaatggtcagttaggcagaatgctccgtcaggcgggtgaaccgttagggattgctgtttatcccgtggggctggatgcagagccggaatcggttccgtttcataacagtgtgattaccgccgagatcgaacgctggccagaaaccgccctcacccgcgagctggctgaacacacggcatttgcgaaccgtgatattttcccacgtctggccgatcgcctgacgcaaaaacagctgttggactcgctgaatctggcaaccgcgccctggcaattgctggccagcgccgatgaatggccacacgtctttgcttcattaggtgagctcgctatcgttaaacgccgcgtcggcggttatgacggccgtgggcagtggcgcttgcgtaacggcgaacagcagacgttgcccgcagactgctacggtgaatgcattgttgagcaagggattaatttttccggcgaagtctcactggttggcgcccgcaatacgcacggtaaatgcgtcttctacccgctaactcataacctgcatcaggatggcattctgcgtaccagcgtggctttccctcagcctgatccgcaattgcaacagcaggctgagcagatgctgtccgcgattatgaatgcgctaggctatgttggcgtgatggcgatggaatgctttattgtcggcgaccatctgctcattaatgagttggctccacgggtacacaatagtggacactggacgcaaaatggcgcgtcgatcagccagtttgaactccatctgcgcgccattctggatctgccgctgccggtaccggtcgtcgaaacgccgtcggtgatggtcaacctgatcggcactgacgtgaatatcgactggctggcgctgccgctggtacatctgcactggtatgagaaagaggttcgtcctggccgcaaagttggacacctcaatctaccgtcgtcggacaccgcacaattgcaacacaccctgcaatcgctggcacctctattaccagaggaataccacagcggtctggcgtgggcagaagaaaaactcaccgcctga

SEQ ID NO: 13805 - protein, 356 aa, Erwinia carotovora subsp. atroseptica SCRI1043
MKPVCVLGNGQLGRMLRQAGEPLGIAVYPVGLDAEPESVPFHNSVITAEIERWPETALTRELAEHTAFANRDIFPRLADRLTQKQLLDSLNLATAPWQLLASADEWPHVFASLGELAIVKRRVGGYDGRGQWRLRNGEQQTLPADCYGECIVEQGINFSGEVSLVGARNTHGKCVFYPLTHNLHQDGILRTSVAFPQPDPQLQQQAEQMLSAIMNALGYVGVMAMECFIVGDHLLINELAPRVHNSGHWTQNGASISQFELHLRAILDLPLPVPVVETPSVMVNLIGTDVNIDWLALPLVHLHWYEKEVRPGRKVGHLNLPSSDTAQLQHTLQSLAPLLPEEYHSGLAWAEEKLTA

SEQ ID NO: 13806 - DNA, 1173 bp, Propionibacterium acnes KPA171202
  CDS (1)..(1173): transl_table=11
atgaacgtcgtgacgtcttacaccatcggaatcattggcggcgggcagttagcccgcatgatgcatcaggctgcgatcggattgggggtgcgcacccgcctgctggcctctgatcctgaagagtctgcggcccaggtgatgtctgacgtcgtcgttggctcccacctcgaccacgacgctgttatgaatttcgccgccgggtgcgatgccgtcaccttcgaccacgaacacgtaccgacggtcctcgttgaggagatggaagaggccgggtacgcggtccgcccaggggcggccgccatggttcacgcgcaagacaaggtcgtcatgcgtgagtttatggagcgcgagggtttcccgaatcctgcgtggcaggtttgcgacactcccgaagacctcgtctcttttggtcatgaccgtggctggcctgtcattgcgaaaacctcccgtggcggttatgacggcaaaggagtgttcaagatcgacggccccgatggtgctggtgagccctttgacgcggccggggatctggccgacggcaagcagccgattcgtattctcgcggaagagttcgtcgatttccgacgcgaactctccgcggtcgttgtgcgctccccgtcgggtcagggagccgcgtacccggttaccgaaactattcagcgtcacggggtatgtgcggagactatcagcccggcccctgacctctcgtcggaccgtcaagttgagctgcaaaccatggcgctcgacattgctggacgcctcgacgtcatcggggtgctggcagtcgagctgatggagcgtgaggacggatccgtcgtcgtcaatgagctggcgacccgtcctcacaacactgcccattggacgatcgacggagctgagacgagtcagtttggaaaccacatgcgagccgtgcttaacctacccctcggttcaccggccctgatcgctcccgttgttgtcatggccaacgtcctcggtgggtccgaagaggatttgaccggggctttgcaacattgcttcgctcgtgacccagaacttcgcgtcgagctgtacggcaagtccgtgcggcccggtcgcaaggtcggtcacgtcacctgccttggtaacgacattgagacgactcatcgtcgggcccgccatgccgccgcctaccttatgggagaacacgatgcctga

SEQ ID NO: 13807 - protein, 390 aa, Propionibacterium acnes KPA171202
MNVVTSYTIGIIGGGQLARMMHQAAIGLGVRTRLLASDPEESAAQVMSDVVVGSHLDHDAVMNFAAGCDAVTFDHEHVPTVLVEEMEEAGYAVRPGAAAMVHAQDKVVMREFMEREGFPNPAWQVCDTPEDLVSFGHDRGWPVIAKTSRGGYDGKGVFKIDGPDGAGEPFDAAGDLADGKQPIRILAEEFVDFRRELSAVVVRSPSGQGAAYPVTETIQRHGVCAETISPAPDLSSDRQVELQTMALDIAGRLDVIGVLAVELMEREDGSVVVNELATRPHNTAHWTIDGAETSQFGNHMRAVLNLPLGSPALIAPVVVMANVLGGSEEDLTGALQHCFARDPELRVELYGKSVRPGRKVGHVTCLGNDIETTHRRARHAAAYLMGEHDA

SEQ ID NO: 13808 - DNA, 1110 bp, Streptococcus pyogenes MGAS10394
  CDS (1)..(1110): transl_table=11
atgaggaacaaggaaaaatcgcagaggagtcaagcaatgaactcatttaagactattgggattattggtggtggtcagctagggcagatgatggccattgcggccatctatatgggccacaaggtcatcacgctggatcctactaatgactgccctgcctcccgcgttagcgaggtaattgtggcgccttacgatgatgttgaggctttgggacaattggctgcgtgttgcgatgtgttgacttatgagtttgagaatgttaatgcggacggtttggatgccgttgtgtcagcttgtcagctaccgcaggggaccgatctgctccgcatttcccaaaaccgtatctttgaaaaagactttctggcaaataaggctggtgtgactgttgctccctataaggtggtgacgtctagccttgacctagaggggcttgattttaccaagacctatgtcctcaagacagcgacaggtggttatgacggtcatgggcaaaaggttatccgctcagcagaagatttgccagaggcgcagcaattagctaactcagctcagtgtgtcttggaagagtttgtcaactttgaccttgaaatctcagtcatcgtgtctggaaatggagaggatgtgacggtctttcccgttcaggaaaatatccactgcaacaatatcctgtcaaaaactatcgtgccagctcgtatctcagatcaactggctgataaggctaagaaaatggcggtgcagattgccaagaaactccagctgtcaggaactctctgtgtggaaatgtttgcgaccgcagatgatatcattatcaatgaaattgccccacgtccccacaactcagggcactactcaatcgaggcttgcgacttttcacagtttgacacccacattttgggcgtactcgggcaacctctcccaccaatcaaactccatgctccagccgtcatgcttaatgtcctcggacaacacgtccagcaggcaattgactatgttgcccaaaaccctagcgcccacctccacatgtatggtaaactagaagcgaaacataaccgcaaaatgggacatgtgacactatttgcagaagatgcagatgaggtggaggagttttag

SEQ ID NO: 13809 - protein, 369 aa, Streptococcus pyogenes MGAS10394
MRNKEKSQRSQAMNSFKTIGIIGGGQLGQMMAIAAIYMGHKVITLDPTNDCPASRVSEVIVAPYDDVEALGQLAACCDVLTYEFENVNADGLDAVVSACQLPQGTDLLRISQNRIFEKDFLANKAGVTVAPYKVVTSSLDLEGLDFTKTYVLKTATGGYDGHGQKVIRSAEDLPEAQQLANSAQCVLEEFVNFDLEISVIVSGNGEDVTVFPVQENIHCNNILSKTIVPARISDQLADKAKKMAVQIAKKLQLSGTLCVEMFATADDIIINEIAPRPHNSGHYSIEACDFSQFDTHILGVLGQPLPPIKLHAPAVMLNVLGQHVQQAIDYVAQNPSAHLHMYGKLEAKHNRKMGHVTLFAEDADEVEEF

SEQ ID NO: 13810 - DNA, 1170 bp, Leifsonia xyli subsp. xyli str. CTCB07
  CDS (1)..(1170): transl_table=11
atgaggagtatcagaggagaggtacaggcgatggccaggaacagagttggtgtgatcggcggcggacagctggcgcggatgatgatctccccggcggtggagctgggcgtggacatccgtgtgctccaggaggccgagggcatgagcgccgatctcgccgccagcggcgtcggcgactaccgcgacctcggtgccgtcctcgccttcgcggagacggtggatgttgtgaccttcgaccacgagcacgttccgccggccatcctccgtgagctggtcgctcgcggcgtcccggtccaccccgggccggacgcgctgctctatgcgcaggacaagattcagatgcgctcgaagctcggcgatctcggccttcccgttccggactgggcggccgtggagacctccggcgagctcgccgcgttcctcgacgaccacggcggccgcgcggtcgtcaagacggcccgcggaggctacgacggcaaaggcgtccgtctggtctcggacgcgaacggggcggacgactggttcctcgcgctcgccgaggacggtctcggtggcgctctgctggtcgaggagctcgtctctttccgccgcgagctggcccagctggtcgcgcggcggccctccggcgaggtcgtcgcctggcccgtcgtcgagaccgtgcagcgcgacggcgtgtgcgccgaggtgatcgccccggcccccggctcggccggccgtctcgcgcaggcggcgtcggacatcgcccgccgcatcgcagacggcttgggcgtgaccggcgtcctcgccgtcgaactgttcgagacgaccgacggccgggtgctggtcaacgagctcgcgatgcgcccacacaacagcggccactggtcgatcgagggcgccgtgaccagtcagttcgagcagcatctgcgcgccgtgctcgatctgccgctgggcgcggcgacggcgcgcgaggactggtcggtgatggtcaacatcctgggcgggccgtcggagggaaccctgcaggaccgctacccggccgcgctcgcggcgcaccccgaagccaaattccacggttacggaaaggcgccgcgccccggccggaaagttggccatgtgacggtctgcggcgacgatctggacgacatcgcgtaccgcgcacggtcggcggccgccttcttcgaggggtga

SEQ ID NO: 13811 - protein, 389 aa, Leifsonia xyli subsp. xyli str. CTCB07
MRSIRGEVQAMARNRVGVIGGGQLARMMISPAVELGVDIRVLQEAEGMSADLAASGVGDYRDLGAVLAFAETVDVVTFDHEHVPPAILRELVARGVPVHPGPDALLYAQDKIQMRSKLGDLGLPVPDWAAVETSGELAAFLDDHGGRAVVKTARGGYDGKGVRLVSDANGADDWFLALAEDGLGGALLVEELVSFRRELAQLVARRPSGEVVAWPVVETVQRDGVCAEVIAPAPGSAGRLAQAASDIARRIADGLGVTGVLAVELFETTDGRVLVNELAMRPHNSGHWSIEGAVTSQFEQHLRAVLDLPLGAATAREDWSVMVNILGGPSEGTLQDRYPAALAAHPEAKFHGYGKAPRPGRKVGHVTVCGDDLDDIAYRARSAAAFFEG

SEQ ID NO: 13812 - DNA, 1143 bp, Symbiobacterium thermophilum IAM 14863
  CDS (1)..(1143): transl_table=11
atgatccggcccggcgaggtggtcggcattgtcggcggcgggcagctggcccgcatgtcggcactggccgccagggcgatgggataccgggtcgccgtcgccgatccggaccccgactgcccggctgcgccggtggccgatcgggtgatcgtgggcgcgctgaacgacccggaggccctggcgcccctggccgacgtggcctccgtgatcacgtacgagtttgagaacatcgacggtgcggtgctggaccggctggccgcgcgccggcccgtgcacccccgggtggagatcctgcgcacctgccagaaccggatctccgagaagcaggccctggagcggctgggcatccccgtcgccccctggcgtcccgtgcgctcggcggacgagatccccgccgccctcgaggccgtcgggctgccggccgtgctgaagaccgcgactatgggctacgacggcaaggggcaggcggtgatccgcacgacggcggaggcggagcgggccctcgaggcgctgggcggcggtccgctggtgctggagcggctggtggacttcgcctgcgagctgtccgtggtggtggcccgcagcgcatccggccatgtggccccgttcccggtcgccgagaacatccatgcgcggaacatcctcgcgtactccattgtgcccgcccgggtcgacccggcggtgcaggccgccgcccgggacctcgcggtgcgcatcgccgaggggctcgggctggtggggctgttaggcgtggagatgttctgcctgcccgacggccgcctgctggtcaacgagctggccccgcgcccgcacaactcgggccactacacccaggatgcctgcgcgacgtcccagtttgagcaacacatccgggccgtgtgcgacctgccgctgggcgccgtggacctgctcagcccggtgtgcatggtcaacgtgatgggcgaggacttcccgctggacgtgggcgcggcgctctccgacccgcacgtgaagctgcacctttacggcaagcgggagccccgcccccaccggaagatgggccacctgaacgtgctggcccccaccgccgacgaggccctggagcgggcccgggaggcgaaggcggcgatcgcggggaccgcagggcaacccaggcaggcgtga

SEQ ID NO: 13813 - protein, 380 aa, Symbiobacterium thermophilum IAM 14863
MIRPGEVVGIVGGGQLARMSALAARAMGYRVAVADPDPDCPAAPVADRVIVGALNDPEALAPLADVASVITYEFENIDGAVLDRLAARRPVHPRVEILRTCQNRISEKQALERLGIPVAPWRPVRSADEIPAALEAVGLPAVLKTATMGYDGKGQAVIRTTAEAERALEALGGGPLVLERLVDFACELSVVVARSASGHVAPFPVAENIHARNILAYSIVPARVDPAVQAAARDLAVRIAEGLGLVGLLGVEMFCLPDGRLLVNELAPRPHNSGHYTQDACATSQFEQHIRAVCDLPLGAVDLLSPVCMVNVMGEDFPLDVGAALSDPHVKLHLYGKREPRPHRKMGHLNVLAPTADEALERAREAKAAIAGTAGQPRQA

SEQ ID NO: 13814 - DNA, 1143 bp, Bacillus licheniformis ATCC 14580
  CDS (1)..(1143): transl_table=11
ttgtataaacaaacgatttttccgggagcgacaatcggcattatcggaggcggacagctgggcaaaatgatggccgtcgcggccaaacaaatgggctataaaatcgcggtggttgatcctgttccttcatcaccgtgcggccaggtcgccgaccttgagattacggctagctataatgacggggaagcgatacggaagcttgccgaagcgagcgacgtgatcacttacgaattcgagaacatcgattatgacgcgctgaactggctgaaggagcacgcttaccttccgcaggggagcgagcttttgctccttacgcaaaacagggagaccgagaaaaaagcgattgcatcagcgggctgtaaagtcgcgccgtaccggatcattcacgaccgggcggaattggaagcgtccgtagcggagctcggtcttccggcggtgctgaaaacttgccgcggcgggtatgacggaaaagggcagcacgtcctgaaagaacaagcacaaatcggggaagccgcagctcttttacagcacggcacatgcattttggaaagctgggttcctttcaaaatggaattgtccgtgatcgtgacaagatcggttcacggagagacaaccgtctttccggcggcagaaaacatccataaacaaaatattttattccagagcatcgtcccggcccgggtcgatgaggcgattcaggaacaagcggcagcacttgccctcaggcttgccgaaaagcttcagcttgtcggaacactggccgttgagcttttcctgaaggaagacggcggccttctcgtcaatgaactggcgccgcggccgcataattccggccattacacccttgatctttgcgaaacgagccagtttgaacagcatattcgtgcggtctgcgggctgccgctcggtaaaacggatcttctgaaggaagggatgatggtgaaccttctcggggacgaagtgtacatggctgaagaagatcccgaacttttaaaagaagcgaagctttatatatacggaaagcatgaagtcaaaccaggccgcaaaatggggcacatcacatttttaagaacacccgacaatgaatggatcgggcagatgacagaaaagtggattgaaagagatggaggacgaaaacaatga

SEQ ID NO: 13815 - protein, 380 aa, Bacillus licheniformis ATCC 14580
MYKQTIFPGATIGIIGGGQLGKMMAVAAKQMGYKIAVVDPVPSSPCGQVADLEITASYNDGEAIRKLAEASDVITYEFENIDYDALNWLKEHAYLPQGSELLLLTQNRETEKKAIASAGCKVAPYRIIHDRAELEASVAELGLPAVLKTCRGGYDGKGQHVLKEQAQIGEAAALLQHGTCILESWVPFKMELSVIVTRSVHGETTVFPAAENIHKQNILFQSIVPARVDEAIQEQAAALALRLAEKLQLVGTLAVELFLKEDGGLLVNELAPRPHNSGHYTLDLCETSQFEQHIRAVCGLPLGKTDLLKEGMMVNLLGDEVYMAEEDPELLKEAKLYIYGKHEVKPGRKMGHITFLRTPDNEWIGQMTEKWIERDGGRKQ

SEQ ID NO: 13816 - DNA, 1152 bp, Bacillus cereus E33L
  CDS (1)..(1152): transl_table=11
atgacgagaatcattttacctggaaaaacaatcggcattattggaggcggccagctaggaagaatgatggcattggcagctaaggaaatgggatataaaattgctgttttagatcctacaaaaaactcaccatgtgcacaagttgctgatattgaaattgttgcatcatatgacgatttaaaagcaattcagcatttagccgagattagtgatgttgtcacatatgaatttgagaatattgattatagatgtttacaatggcttgaaaagcatgcttacttaccgcaaggcagtcagttgttaagtaaaacacaaaatcgttttactgaaaagaatgcaattgaaaaagcgggattaccagtagcaacgtatagattggttcaaactcaagagcagcttactgaagcaatcgccgagttatcatatccttctgtcttaaaaacaacgacaggtggatatgatgggaaagggcaagttgttttaagaagtgaagctgacgttgatgaagcgcgaaagcttgcgaatgcagcagagtgtattttagagaaatgggtgccttttgaaaaagaagtatcagttatcgtaattcgtagtgtaagtggtgaaacgaaagtatttccggtagcggaaaatattcatgtaaataacattttgcatgaatccatcgttccagctcgcattacagaagaactttctcaaaaagcaattgcttatgcaaaagtgcttgcggatgaactagaacttgtgggaacactagcggtagagatgtttgctacagctgatggtgagatttatattaatgaactagcaccaagacctcacaattcaggacactatacacaggatgcatgtgaaacgagtcaattcggtcaacatattcgagcaatctgtaatttacctcttggagaaacaaatttgttaaaaccagttgtcatggtaaacattttaggcgaacatatagaaggggtcctaagacaagtgaatagattaaccgggtgctatttacacttgtatggaaaagaagaagcaaaagcgcagcgaaaaatggggcatgttaatattttaaatgataatattgaagtcgctctagaaaaagcgaagagtttgcatatttgggaccatcaagaacaactgttggagggaaaaagatga

SEQ ID NO: 13817 - protein, 383 aa, Bacillus cereus E33L
MTRIILPGKTIGIIGGGQLGRMMALAAKEMGYKIAVLDPTKNSPCAQVADIEIVASYDDLKAIQHLAEISDVVTYEFENIDYRCLQWLEKHAYLPQGSQLLSKTQNRFTEKNAIEKAGLPVATYRLVQTQEQLTEAIAELSYPSVLKTTTGGYDGKGQVVLRSEADVDEARKLANAAECILEKWVPFEKEVSVIVIRSVSGETKVFPVAENIHVNNILHESIVPARITEELSQKAIAYAKVLADELELVGTLAVEMFATADGEIYINELAPRPHNSGHYTQDACETSQFGQHIRAICNLPLGETNLLKPVVMVNILGEHIEGVLRQVNRLTGCYLHLYGKEEAKAQRKMGHVNILNDNIEVALEKAKSLHIWDHQEQLLEGKR

SEQ ID NO: 13818 - DNA, 1089 bp, Mannheimia succiniciproducens MBEL55E
  CDS (1)..(1089): transl_table=11
atgcaaaaaagtgctttatatccgaccgtttacgtacttggaaacggtcaattaggacgtatgcttcgctatgccggcgctcctttagatattaacgttcaaccgcttgcgtttaatgcgtccgttttcgatttaccgaaagacagcattatcaccgctgaaattgagcgctgggaagaaaccccgcttacaaccatgctgggcaatcatcataaatttgtgaataaaaacgtatttgttaaaactgcggatcgtttaacccaaaaatctttactggacgaactggcattaccgacctcaccatggtgtttggtcgaaaaccaccaacaatgggcggatattttcacaaacgtaggtgaaaaagtggtggttaaacgccgtatgggcggttatgacgggcgcggtcaatggattattacggaagaaaataaaacgctaatcactgatgagttgctcaatgaggttattgccgaaaaattcattcccttcgattatgaaatttctctggtcggcgcccgtttcagaaacggcgacacccgtttttatcccgtaacccataatcttcaacaagacggcatcttgcgttacagtgtaactgatgaaacattccctcaacaagctcggcaacaggttcaggcggaagccatgttaagcaaaataatggcaaaactggattatgtaggcgttatggctatggaatgttttgtggtgggcgacaaactgttgattaatgaactggcgccccgtgttcataacagcggtcactggacccaactgggttgctccgtaagccagtttgaattacatttacgcgcactgttagatttgcctacgcccaaattaaccacctttgccccaagtgtaatggttaatttaatcggtacggatcataataaattatggcttgatacgccgttcagccagctccactggtacggcaaggaagttcgcacagggcggaaagtcggtcatatcaatatttctcatccggataaaaacgtgattatcacacagcttgaaaaattagccggcgaactgccgaacgattatcaatccggtttaaattgggcaataaataaattaaaataa

SEQ ID NO: 13819 - protein, 362 aa, Mannheimia succiniciproducens MBEL55E
MQKSALYPTVYVLGNGQLGRMLRYAGAPLDINVQPLAFNASVFDLPKDSIITAEIERWEETPLTTMLGNHHKFVNKNVFVKTADRLTQKSLLDELALPTSPWCLVENHQQWADIFTNVGEKVVVKRRMGGYDGRGQWIITEENKTLITDELLNEVIAEKFIPFDYEISLVGARFRNGDTRFYPVTHNLQQDGILRYSVTDETFPQQARQQVQAEAMLSKIMAKLDYVGVMAMECFVVGDKLLINELAPRVHNSGHWTQLGCSVSQFELHLRALLDLPTPKLTTFAPSVMVNLIGTDHNKLWLDTPFSQLHWYGKEVRTGRKVGHINISHPDKNVIITQLEKLAGELPNDYQSGLNWAINKLK

SEQ ID NO: 13820 - DNA, 1245 bp, Bacillus licheniformis ATCC 14580
  CDS (1)..(1245): transl_table=11
ttgcggcgcagattttgtcagcttttgacaaagagcttgccgaaagattggacgaacgaagggaaagcatcagacaaaccgtgttggaaagcagtgatcagcttgtataaacaaacgatttttccgggagcgacaatcggcattatcggaggcggacagctgggcaaaatgatggccgtcgcggccaaacaaatgggctataaaatcgcggtggttgatcctgttccttcatcaccgtgcggccaggtcgccgaccttgagattacggctagctataatgacggggaagcgatacggaagcttgccgaagcgagcgacgtgatcacttacgaattcgagaacatcgattatgacgcgctgaactggctgaaggagcacgcttaccttccgcaggggagcgagcttttgctccttacgcaaaacagggagaccgagaaaaaagcgattgcatcagcgggctgtaaagtcgcgccgtaccggatcattcacgaccgggcggaattggaagcgtccgtagcggagctcggtcttccggcggtgctgaaaacttgccgcggcgggtatgacggaaaagggcagcacgtcctgaaagaacaagcacaaatcggggaagccgcagctcttttacagcacggcacatgcattttggaaagctgggttcctttcaaaatggaattgtccgtgatcgtgacaagatcggttcacggagagacaaccgtctttccggcggcagaaaacatccataaacaaaatattttattccagagcatcgtcccggcccgggtcgatgaggcgattcaggaacaagcggcagcacttgccctcaggcttgccgaaaagcttcagcttgtcggaacactggccgttgagcttttcctgaaggaagacggcggccttctcgtcaatgaactggcgccgcggccgcataattccggccattacacccttgatctttgcgaaacgagccagtttgaacagcatattcgtgcggtctgcgggctgccgctcggtaaaacggatcttctgaaggaagggatgatggtgaaccttctcggggacgaagtgtacatggctgaagaagatcccgaacttttaaaagaagcgaagctttatatatacggaaagcatgaagtcaaaccaggccgcaaaatggggcacatcacatttttaagaacacccgacaatgaatggatcgggcagatgacagaaaagtggattgaaagagatggaggacgaaaacaatga

SEQ ID NO: 13821 - protein, 414 aa, Bacillus licheniformis ATCC 14580
MRRRFCQLLTKSLPKDWTNEGKASDKPCWKAVISLYKQTIFPGATIGIIGGGQLGKMMAVAAKQMGYKIAVVDPVPSSPCGQVADLEITASYNDGEAIRKLAEASDVITYEFENIDYDALNWLKEHAYLPQGSELLLLTQNRETEKKAIASAGCKVAPYRIIHDRAELEASVAELGLPAVLKTCRGGYDGKGQHVLKEQAQIGEAAALLQHGTCILESWVPFKMELSVIVTRSVHGETTVFPAAENIHKQNILFQSIVPARVDEAIQEQAAALALRLAEKLQLVGTLAVELFLKEDGGLLVNELAPRPHNSGHYTLDLCETSQFEQHIRAVCGLPLGKTDLLKEGMMVNLLGDEVYMAEEDPELLKEAKLYIYGKHEVKPGRKMGHITFLRTPDNEWIGQMTEKWIERDGGRKQ

SEQ ID NO: 13822 - DNA, 1080 bp, Legionella pneumophila subsp. pneumophila str. Philadelphia 1
  CDS (1)..(1080): transl_table=11
atgaaacttggtattctaggtggtggccaacttgcaagaatgttggcattagcagcatatcccttagggattaacactgtctgcctggatcccagccctgatgcttgtgctggccaactcaccaggctgatagtctctgattttaatgatgaattggctttaaaacaatttttgtcagaagtggattgcgtcacaatagaaaccgaaaatataccattttcttgtgccgaattaattgcccaaataaagcctttttatccatcaacccaagctttgaaaattacgcaagacagattatatgaaaaaaattttttcaggtctctgaatattcctactccagaatttttaccagttgaatctgaaggtgaattgatgcaggctattacggacataggaatgcctgccgtgttaaaaacaagaaggtttggctatgatggcaagggccaatttgttttgcgagcccaatcagatatttcaaaaagttggggcctgttaggcagtcagcctctcattctcgaagagttaatttcctttgaaagtgaattttcgctaattgctgttcgcaataagagtggtgaaacaagtttctacccattgattaaaaatcatcacaggaagggcattttacatttctcagaagcccctgttcatcaggacaccttacaacaggaggcgcaaactcatgcattcaaaattttagaagccctgaattatgttggtgtacttaccattgagtttttttatcaaggcaaccaattgattgcgaatgagatagcaccacgcgttcataattctggccactggactatcgagggagcacatactagccaattcgaaaatcatctgcgcgctctttttgatttgcccttgggaagcactgaagtaagcggctcttgttttttattaaattgcattggcaatctgctgccattggagccctgtttatcgatcccgggtgttcattatcacgcttatggaaaagccccccggccagatcgcaaggtaggtcatgttacccttatcgatactcatttggaacgttatgcaaaaagcaaagacttacttcttgacatttcatga

SEQ ID NO: 13823 - protein, 359 aa, Legionella pneumophila subsp. pneumophila str. Philadelphia 1
MKLGILGGGQLARMLALAAYPLGINTVCLDPSPDACAGQLTRLIVSDFNDELALKQFLSEVDCVTIETENIPFSCAELIAQIKPFYPSTQALKITQDRLYEKNFFRSLNIPTPEFLPVESEGELMQAITDIGMPAVLKTRRFGYDGKGQFVLRAQSDISKSWGLLGSQPLILEELISFESEFSLIAVRNKSGETSFYPLIKNHHRKGILHFSEAPVHQDTLQQEAQTHAFKILEALNYVGVLTIEFFYQGNQLIANEIAPRVHNSGHWTIEGAHTSQFENHLRALFDLPLGSTEVSGSCFLLNCIGNLLPLEPCLSIPGVHYHAYGKAPRPDRKVGHVTLIDTHLERYAKSKDLLLDIS

SEQ ID NO: 13824 - DNA, 1197 bp, Burkholderia mallei ATCC 23344
  CDS (1)..(1197): transl_table=11
atgactgcactccccactccgaattccccgatcctgccgggcgcctggctcggcatggtcggcggcggccagctcggccgcatgttctgctttgccgcgcaagcgatgggctaccgcgtcgccgtgctcgatcccgatccgacgagccccgcgggcgccgtcgccgacaagcatctgcgcgccgcgtacgacgacgaggccgcgctcgccgagctcgcgcaattgtgcgatgccgtatcgaccgaattcgagaacgtgcccgccgcgagcctcgagctgctcgcgcaatcgacgttcgtcgcgccggccggccggtgcgtcgcgatcgcgcaggaccggatcgccgagaaacgattcatcgcggcgtcgggcgtgcccgtcgcgccgcacgtcgtgatcgaatcgcacgcgcagctcgccgcgctcgccgatgcggacctcgccgcggtgctgcccggcatcctgaagaccgcgcgtctcggttacgacggcaaggggcaggtgcgtgtcgcgacggtgcgcgaggcgcgcgacgcgtacgcgtcgctcggcggcgtgccttgcgtgctcgagaagcgcctgccgctcgaatacgaggtgtcggcgctgatcgcgcgcggcgcgaacggcgcgtcggcggtgtttccgctcgcgcagaacacgcaccacggcggcatcctgtcgctgagcgtcgtgcctgcgcccgccgcgagcgatgcgctcgtgcgcgaagcgcagcaggcggccgtgcggatcgccgattcgctcggctacgtcggcgtgctgtgcgtcgagttcttcgtgctcgaagacggctcgctcttcgcgaacgaaatggcgccgcgcccgcacaactccggccattacacggtcgacgcgtgcgagacgagccagttcgagcagcaggtgcgcgcgatgacgcggctgccgctcggcagcacgcgccagcattcgcccgccgcgatgctcaacgtgctcggcgacgtgtggttcgcgaacggcgtgtcgggtgagcccgtcacgccgccgtgggacgaggtcgccgcgatgccgaccgcgcggctgcatctgtacggcaaggaagaggcgcgcgccggccgcaagatgggccatgtgaacttcaccgcggcgacgcgcgacgaagcggtcgccggcgcgaccgcgtgcgcgcggctgttgcgcattgcgctcgactga

SEQ ID NO: 13825 - protein, 398 aa, Burkholderia mallei ATCC 23344
MTALPTPNSPILPGAWLGMVGGGQLGRMFCFAAQAMGYRVAVLDPDPTSPAGAVADKHLRAAYDDEAALAELAQLCDAVSTEFENVPAASLELLAQSTFVAPAGRCVAIAQDRIAEKRFIAASGVPVAPHVVIESHAQLAALADADLAAVLPGILKTARLGYDGKGQVRVATVREARDAYASLGGVPCVLEKRLPLEYEVSALIARGANGASAVFPLAQNTHHGGILSLSVVPAPAASDALVREAQQAAVRIADSLGYVGVLCVEFFVLEDGSLFANEMAPRPHNSGHYTVDACETSQFEQQVRAMTRLPLGSTRQHSPAAMLNVLGDVWFANGVSGEPVTPPWDEVAAMPTARLHLYGKEEARAGRKMGHVNFTAATRDEAVAGATACARLLRIALD

SEQ ID NO: 13826 - DNA, 1131 bp, Methylococcus capsulatus str. Bath
  CDS (1)..(1131): transl_table=11
atggcgcacattctgcctcccgcgatgctcggcattctcggcggcggccagttgggccgcatgtttgcgatggcggcccggtccatgggctatcgggtgaccgtgctggatcccgatgtccagagcccggccgggagcgtggcggaccgccacatccgcgccgcctatgatgacgagggggcgctcgaagatctggcgtcgggctgtgccgcggtgaccaccgaattcgagaacgtccccgccgacagcctgcgcttcctggaatctcggacgcgggtgtcgccttcctcggcttgtgtggccattgctcaggaccgtatcctcgaaaaacgctatatcgccggtgccggtctggccgtggcgccgttcctggcggtggatgctccgcaggatctggccggcgacctcgcgcccctgctgccggggattctcaagacggcgcgtttcggctacgacggtaaagggcaggtgcgggtcgccacccccgaggacgtccatggcgccttcgaagctttgggctgccgtccctgtgtgctggagaagcggctggacctcgagaccgaaatctcggtgatcgtggcgcggacttcggcggaactcgtcagaaccttcccggtcgccgaaaacaggcacgaggcgggcatcctcgatgtcagcatcgtgccagcgcgggtgacgccggacatcgccgcgcgggcctgcgagatggcctgtgccctggcggaggccatggactatatcggtgtgctggcggtggagtttttcgtgctggaggagggcggactggtcatcaacgaaatcgcgccacgcccccacaacagcggtcatcacaccctcgatgcctgcgccgtgagccagttcgggcagcaggtccgcacgctgtgcgggctccctcccgcggacacgcgcctgctcagtcccgtggtcatggtgaacctcctcggggacatctggcgggacgacgagccggcctgggatctggtcctgagcgagcccgccgcggtcctgcatctttatggtaaggccagcgccagggcggggaggaagatgggccatttcaacgtgctggccgaaaccgtcgatgcggccctggagaaggcggaagccctcaagcgtgccctgcggcgctga

SEQ ID NO: 13827 - protein, 376 aa, Methylococcus capsulatus str. Bath
MAHILPPAMLGILGGGQLGRMFAMAARSMGYRVTVLDPDVQSPAGSVADRHIRAAYDDEGALEDLASGCAAVTTEFENVPADSLRFLESRTRVSPSSACVAIAQDRILEKRYIAGAGLAVAPFLAVDAPQDLAGDLAPLLPGILKTARFGYDGKGQVRVATPEDVHGAFEALGCRPCVLEKRLDLETEISVIVARTSAELVRTFPVAENRHEAGILDVSIVPARVTPDIAARACEMACALAEAMDYIGVLAVEFFVLEEGGLVINEIAPRPHNSGHHTLDACAVSQFGQQVRTLCGLPPADTRLLSPVVMVNLLGDIWRDDEPAWDLVLSEPAAVLHLYGKASARAGRKMGHFNVLAETVDAALEKAEALKRALRR

SEQ ID NO: 13828 - DNA, 1071 bp, Anaplasma marginale str. St. Maries
  CDS (1)..(1071): transl_table=11
atgccaaaatcatatgtccacactggtaccgtcattggcatcatgggcggaggacaactcggtaagatgacgtccctggccgcatcacaaatgggttacagaacccacgtatttgcagaacaccatggtgacccagcagtcttcgttaccaacacctctaccattgcaagttttagtgatggcagcaaactgtcggattttgcatctacaattaacctcgcggtaatagaatttgaaaacatacctgccagtgcagtggacaccgttgcagcaaaagcccccgtatacccgggcagagctgcactgcatattgcgcaaaacaggatacgagaaaagcagcacatatgtaatcttggcatcccggtagcggattttgcggtagtaaacagccacgcagaacttctaggtagcattgacgacattggctacccatgcctactcaagaccgcagagctaggatacgatggcagggggcagtacacgctaaaaagcagcagcgatatcgccggggcgtcatccctggattggagccgcagctatattttggaaaagcttgtcgatattcacgaagagatctccctgattatcgctgtggcagcggacggatcacacgagctgtttccaattgcccaaaactatcacgttgacggtattttggatagatcaatcgtccccgcacaagttacgcgttccgtgcacgagcaggcggcagagatggccatcaccatagcaacttcgcttggcattgtgggaattttagctgttgagttttttattacaacagacggatcattgttggtaaatgagatagcgccacgcccgcataattccggccattggagcatggatgcatgcaatgttagccaatttgagcagctagtgcgcgcggcgtgtggcttgccgcttcggaaagtgcagttgcttgcgccctgcgtcacaaaaaacgtttttggtgacacggccacagtctaccaaacacactcacattcgaatagtagcgtacacatatatggcaagttagagcctaggcagcgcagaaagatggggcatgtgaatattctcgattattag

SEQ ID NO: 13829 - protein, 356 aa, Anaplasma marginale str. St. Maries
MPKSYVHTGTVIGIMGGGQLGKMTSLAASQMGYRTHVFAEHHGDPAVFVTNTSTIASFSDGSKLSDFASTINLAVIEFENIPASAVDTVAAKAPVYPGRAALHIAQNRIREKQHICNLGIPVADFAVVNSHAELLGSIDDIGYPCLLKTAELGYDGRGQYTLKSSSDIAGASSLDWSRSYILEKLVDIHEEISLIIAVAADGSHELFPIAQNYHVDGILDRSIVPAQVTRSVHEQAAEMAITIATSLGIVGILAVEFFITTDGSLLVNEIAPRPHNSGHWSMDACNVSQFEQLVRAACGLPLRKVQLLAPCVTKNVFGDTATVYQTHSHSNSSVHIYGKLEPRQRRKMGHVNILDY

SEQ ID NO: 13830 - DNA, 1161 bp, Azoarcus sp. EbN1
  CDS (1)..(1161): transl_table=11
atgatcctccctcccgcaaccctcggcatgctcggtggcggccaactcggccgcttcttcgtttctgccgcccacgaaatgggttaccgcgtgtgggtgctcgatcccgactcgcatagcccggccggcctgatcgccgaccgccacctcgtcgccgcctacgatgactacgccgcactcgacgagctcgccggggcctgtgccggggtgacgaccgagttcgaaaacgtcccggccgcgacgctcgattacctcgccaaattcctttcggtgcacccttcggcgagcgccgtggcggtgtgccagaaccgcatcgcagaaaagacttttctcgccgacaacggcctgccgcacggcccgttcgcggtcgtacgcagcgaggccgaagtccgcaatgccgcgcccgagctgttccccgcagtcctcaaggtggcgcgcttcggctatgacggcaaggggcaggcgcgtgtcgcgaaccctgacgaagccttgcacgcgttccaccagttcggcggtgaagcgtgcatgctcgagaagatgctgagtctcgattgcgaattgtcggtcgtcctcgcgcgcgacgaggcgggcaacgtgagctgtttcgacccctccgaaaaccgccaccgccacggcattctcgacatcaccatcgcgcccgccggggtcgcttcggcactcatcgcgcgggcgcgcgaggtcgccgggcaaatcgccgaaaagctcgactatgtcggcacgctcggtgtcgagttcttcgtctgcggcggcgcactttacgtgaacgaaatggcgccccgcccgcacaacagcggccatcacacgatcgatgcctgtgtcacgagccagtacgaacagcaggtgagggcgctgtgcggactgccgctcggcgagccgcgcgcgcacagcgctgcggtgatggtgaatctgctcggcgaactctggtacgacggcgcgcatatgggtggcacataccgtgagcccgactggtccgtgctccacgcagtgccgaatctccgcctgcacctgtacgcaaaacatcacgcgcgcgcagggcgaaaaatggggcatttcaccgtgatcggcggcgacgccgaaaaaacgctcgccgcggcgctgcacgggcgggcagtgatcggcatccgcgatgacgagcgctga

SEQ ID NO: 13831 - protein, 386 aa, Azoarcus sp. EbN1
MILPPATLGMLGGGQLGRFFVSAAHEMGYRVWVLDPDSHSPAGLIADRHLVAAYDDYAALDELAGACAGVTTEFENVPAATLDYLAKFLSVHPSASAVAVCQNRIAEKTFLADNGLPHGPFAVVRSEAEVRNAAPELFPAVLKVARFGYDGKGQARVANPDEALHAFHQFGGEACMLEKMLSLDCELSVVLARDEAGNVSCFDPSENRHRHGILDITIAPAGVASALIARAREVAGQIAEKLDYVGTLGVEFFVCGGALYVNEMAPRPHNSGHHTIDACVTSQYEQQVRALCGLPLGEPRAHSAAVMVNLLGELWYDGAHMGGTYREPDWSVLHAVPNLRLHLYAKHHARAGRKMGHFTVIGGDAEKTLAAALHGRAVIGIRDDER

SEQ ID NO: 13832 - DNA, 1074 bp, Silicibacter pomeroyi DSS-3
  CDS (1)..(1074): transl_table=11
atgagtgaggctctgaaaccgggcgcccggatcggtattctgggtggcggccagttgggccggatgctctcggttgccgccgcgcggctgggctttgtcacccatatctatgaaccgggcgccaacccgcccgccggtcaggtggccgaccgggtcaccaccgcaggctatgacgacgccgaagcgctggcacagttcgccgcctcggtcgacgtgatcacctatgagtttgagaatatcccgaccgaggcgctggacatccttgaggcgcaccgccccatccgccccgagcgcgaggcgctgcgggtgagccaggaccggctgaccgagaaaagctttctgcgcgatctgggcctgatgacggcgccctttgccgatgtgaccgatctggagagcctcgaggccgcgattgctgagatcggcacgcccgcgatcctcaagacccggcgctttggctatgacggcaagggacaggcgcggctgaaagcgcccggggatgccgcggcggcgctggccgacatggccggcgcgcccgcgatcctggaagggttcgttcagttcagccacgaggtctcggtcatcgccgcgcgcgggctcgacgggcaggtcgcctgtttcgatcccggcgagaacgtgcatcgcgacggtatcctgcacaccaccaccgtgcccgcgcggctgagcgcggcgcagcgcaccgacgcggtgctgctggcggcgcggatcctgaacgcgctcgactatgtgggtgtgatgggggtcgagctgttcgtgacccctgccgggctgatcgtgaacgagatcgcgccccgggtgcataactcgggacactggacccagaacggctgcgccgtggaccagttcgaacagcatatccgcgcggtggcgggatggccgctgggcgacgggcagcggcataccgatgtggtgatggagaacctgatcggcgccgacatggaccggatacccgagctggcgcgcgagcgtgatctggcactgcatctctatggcaaggccgaggccaagcccggccgcaagatgggccatgtcaaccggatgaagcggaacggttga

SEQ ID NO: 13833 - protein, 357 aa, Silicibacter pomeroyi DSS-3
MSEALKPGARIGILGGGQLGRMLSVAAARLGFVTHIYEPGANPPAGQVADRVTTAGYDDAEALAQFAASVDVITYEFENIPTEALDILEAHRPIRPEREALRVSQDRLTEKSFLRDLGLMTAPFADVTDLESLEAAIAEIGTPAILKTRRFGYDGKGQARLKAPGDAAAALADMAGAPAILEGFVQFSHEVSVIAARGLDGQVACFDPGENVHRDGILHTTTVPARLSAAQRTDAVLLAARILNALDYVGVMGVELFVTPAGLIVNEIAPRVHNSGHWTQNGCAVDQFEQHIRAVAGWPLGDGQRHTDVVMENLIGADMDRIPELARERDLALHLYGKAEAKPGRKMGHVNRMKRNG

SEQ ID NO: 13834 - DNA, 1131 bp, Bacillus clausii KSM-K16
  CDS (1)..(1131): transl_table=11
atgaacgaagtgaagccagggagcacgatcggcattattggcggcggccaactgggccggatgatggcgttgtcggctaggcaaatgggttaccggattgccgtgcttgacccgactcctgacgctccgtgtgcccaaatcgcggaccatgtgtttacggccgcctatgatgatgtagaagcgtgcaaacaccttgccaatgtaagtgatgtcatcacatatgagtttgaaaacatagatgaaaaagcagctaaaaaaatcacagagttaagcgacttcccccaagggtttaaagtgcttgggacaacacagcatcgtcttaaggaaaagcaagcgatctctgctttaggggtgcccgtcgccccattttccccgatttatgaggaagccgatatcgaagaagcactcaaggaagtaggcttgccagcagttttgaaaacttgccgcggcggctacgatggcaaaggccaagcggttgtacacacaaaaacggaattagaagcagccgtaaaaacgcttcttgcctcaggggagcttgtgctcgaagcaatgattcctttcgaacgggaaatctcggttattgtcgctaaatcgcgcaatggcgaagtgaagacatttcctgtagcggaaaatgaacataaagacaacattctccatcgtacgatcgttccggcccgcattcaaagcgaaacagaagaacaagcgcttgagttggctgtcaaaatagtgaatggtttgcaggcagtcgggctgttagcggtagaaatgtttgtcaacaaagatgggtcgttgcttgtaaacgaactcgcccctagaccccataattcagggcattatacaatagaagcgtgccgcacttcccagtttgagcaacatatccgcgctgtgtgcggactgccactcggatcgactgaattgttggctgccgcggcaatggaaaacatccttggagacgatgttgccccattgcttggccgccttgaccgtctcggctccgtttcgttgcacctgtatggaaagaaagatgctaaaccaaagcggaaaatggggcacgtaacggcgcttggaaacgatgccgatcactgcctacgcttactggatgaattgtggctacaaacgactttacattaa

SEQ ID NO: 13835 - protein, 376 aa, Bacillus clausii KSM-K16
MNEVKPGSTIGIIGGGQLGRMMALSARQMGYRIAVLDPTPDAPCAQIADHVFTAAYDDVEACKHLANVSDVITYEFENIDEKAAKKITELSDFPQGFKVLGTTQHRLKEKQAISALGVPVAPFSPIYEEADIEEALKEVGLPAVLKTCRGGYDGKGQAVVHTKTELEAAVKTLLASGELVLEAMIPFEREISVIVAKSRNGEVKTFPVAENEHKDNILHRTIVPARIQSETEEQALELAVKIVNGLQAVGLLAVEMFVNKDGSLLVNELAPRPHNSGHYTIEACRTSQFEQHIRAVCGLPLGSTELLAAAAMENILGDDVAPLLGRLDRLGSVSLHLYGKKDAKPKRKMGHVTALGNDADHCLRLLDELWLQTTLH

SEQ ID NO: 13836 - DNA, 1080 bp, Ehrlichia ruminantium str. Welgevonden
  CDS (1)..(1080): transl_table=11
atgatacacgatttacatgtcccccctggctcaactattggaattttaggtggtgggcagcttggaaaaatgatatctgttgctgcaacaaaattaggatataagacacatctattaacagacaatctcaataatccatcagtacaagttacaaacaatgtgaccatattagatagccacactaatacagaacaattgcttgaattcgcatcaagtataagtgtagcaaccctagaatttgaaaatattcctagcaatatcatcaatattctacaacagaaaacatcaatttacccaggaatagatgctttatatatttctcaaaatagaataagagaaaaacaacatataagaaatttaggtattgcaactacagatttcgcaattattaataattatgaagacttaatatatacagcatcagaatttggctatcctacattactgaaaacagcagaattaggttatgatggcaaaggacaatatataataagacaaaaagaagacttaagtaagctatcttcactaaactgggaaataacatacgttcttgagaaatttctcaaaatagataaagaaatctctatcataatatcaaaaaatatacatggaataacagagtttttccctgctgcagaaaattatcataataatggtattttagtaagatcttctgtaccagcacaaattaaccaagaaatgcatatcaaagctcaagaattgacaaaaaaaattgcagaatcttttaatttgataggattattagcagtagagttttttattacagaaactcaagaacttatagtcaatgaaattgcacctcgtcctcataattctgggcattggagtttagatgcttgcaatgtaagtcaatttgaacaactagtaagagcaatttgtggattacctctacaaccagtaaagttactgttcccatgtactatgtataatatacttggagaagatatatataaatattataaacatcacacccaaattaatgaaagcgtatacatatatggaaaaaacaaagctagccaaaacaggaaaatgggacacattaatatcttacaatactaa

SEQ ID NO: 13837 - protein, 359 aa, Ehrlichia ruminantium str. Welgevonden
MIHDLHVPPGSTIGILGGGQLGKMISVAATKLGYKTHLLTDNLNNPSVQVTNNVTILDSHTNTEQLLEFASSISVATLEFENIPSNIINILQQKTSIYPGIDALYISQNRIREKQHIRNLGIATTDFAIINNYEDLIYTASEFGYPTLLKTAELGYDGKGQYIIRQKEDLSKLSSLNWEITYVLEKFLKIDKEISIIISKNIHGITEFFPAAENYHNNGILVRSSVPAQINQEMHIKAQELTKKIAESFNLIGLLAVEFFITETQELIVNEIAPRPHNSGHWSLDACNVSQFEQLVRAICGLPLQPVKLLFPCTMYNILGEDIYKYYKHHTQINESVYIYGKNKASQNRKMGHINILQY

SEQ ID NO: 13838 - DNA, 1146 bp, Thermococcus kodakarensis KOD1
  CDS (1)..(1146): transl_table=11
atgagggacggctttagaattggaatcctcggcggcggacagctggccaagatgagcgcgcaggaagcgagaaggatggggtttgatgtcttagttctggatccaaccccgggatgtcccgccagtatggtggctgagcaaatagttgggagcttccaggacggggagatggtaatcgagctcgccgaaagggctgacgtcgtaacttacgacatagagagcgtcaacgttgaggcgctcaaaaaggtggcgaaggagaagccggtcattccagagccgcacgtcttggaggtaatccgcgacaagtacgtccagaagaaggtgttgaggagggcaggagtcccagttccgtggtttcgggagctgaagagtttagatgagcttgaaaacctgatccccgttgtccagaaagcccggagcggtggctacgatgggaggggtgttgtggtcattagagacgaaaaagaccttcaaaaggctctgaacgttccctcgtacgttgaggagctcgtgccgatcgaaaaggagctttccgtcatagtggttcgcaacgatgacgagacgctggcttatccaaccaccgagatggtcttcaacaatgaggggaacattctggacttcctcgtggcccccgggcgggtcgaaaaggacgtcgagaaggaggcagaggagatagccattagagccgttgaagccctcgatgggcgcggggtttttggggtcgagatgttccttgccagggacgggagggtgctcgtgaacgagatcgccccgaggccccacaactcagggcactggacgatagaagcggccgtatcgagccagttcgagcagcacgttagggtagtggccgacctgcccctcgggagcaccgaggtagttttaaacgccgccatggtgaaccttctaggagaaaaaggctattacggaaagcccgtctatgatggggttagtgaagcgctcaggattcctggggttttcgtccacgtatacgggaagagggaggtgttccccttcaggaagatggggcacgttaccgcagttgatagaaccctcccaggcgccatcgagaaggccctgagggcgaaggcactgataagggtaaggggtgaggtgaatgcccaaagtgggaataataatgggtag

SEQ ID NO: 13839 - protein, 381 aa, Thermococcus kodakarensis KOD1
MRDGFRIGILGGGQLAKMSAQEARRMGFDVLVLDPTPGCPASMVAEQIVGSFQDGEMVIELAERADVVTYDIESVNVEALKKVAKEKPVIPEPHVLEVIRDKYVQKKVLRRAGVPVPWFRELKSLDELENLIPVVQKARSGGYDGRGVVVIRDEKDLQKALNVPSYVEELVPIEKELSVIVVRNDDETLAYPTTEMVFNNEGNILDFLVAPGRVEKDVEKEAEEIAIRAVEALDGRGVFGVEMFLARDGRVLVNEIAPRPHNSGHWTIEAAVSSQFEQHVRVVADLPLGSTEVVLNAAMVNLLGEKGYYGKPVYDGVSEALRIPGVFVHVYGKREVFPFRKMGHVTAVDRTLPGAIEKALRAKALIRVRGEVNAQSGNNNG

SEQ ID NO: 13840 - DNA, 1140 bp, Ehrlichia ruminantium str. Welgevonden
  CDS (1)..(1140): transl_table=11
ttgacttatcttttacagcaagattatcattctttaaattgtcatcaacaaatcacttatatgatacacgatttacatgtcccccctggctcaactattggaattttaggtggtgggcagcttggaaaaatgatatctgttgctgcaacaaaattaggatataagacacatctattaacagacaatctcaataatccatcagtacaagttacaaacaatgtgaccatattagatagccacactaatacagaacaattgcttgaattcgcatcaagtataagtgtagcaaccctagaatttgaaaatattcctagcaatatcatcaatattctacaacagaaaacatcaatttacccaggaatagatgctttatatatttctcaaaatagaataagagaaaaacaacatataagaaatttaggtattgcaactacagatttcgcaattattaataattatgaagacttaatatatacagcatcagaatttggctatcctacattactgaaaacagcagaattaggttatgatggcaaaggacaatatataataagacaaaaagaagacttaagtaagctatcttcactaaactgggaaataacatacgttcttgagaaatttctcaaaatagataaagaaatctctatcataatatcaaaaaatatacatggaataacagagtttttccctgctgcagaaaattatcataataatggtattttagtaagatcttctgtaccagcacaaattaaccaagaaatgcatatcaaagctcaagaattgacaaaaaaaattgcagaatcttttaatttgataggattattagcagtagagttttttattacagaaactcaagaacttatagtcaatgaaattgcacctcgtcctcataattctgggcattggagtttagatgcttgcaatgtaagtcaatttgaacaactagtaagagcaatttgtggattacctctacaaccagtaaagttactgttcccatgtactatgtataatatacttggagaagatatatataaatattataaacatcacacccaaattaatgaaagcgtatacatatatggaaaaaacaaagctagccaaaacaggaaaatgggacacattaatatcttacaatactaa

SEQ ID NO: 13841 - protein, 379 aa, Ehrlichia ruminantium str. Welgevonden
MTYLLQQDYHSLNCHQQITYMIHDLHVPPGSTIGILGGGQLGKMISVAATKLGYKTHLLTDNLNNPSVQVTNNVTILDSHTNTEQLLEFASSISVATLEFENIPSNIINILQQKTSIYPGIDALYISQNRIREKQHIRNLGIATTDFAIINNYEDLIYTASEFGYPTLLKTAELGYDGKGQYIIRQKEDLSKLSSLNWEITYVLEKFLKIDKEISIIISKNIHGITEFFPAAENYHNNGILVRSSVPAQINQEMHIKAQELTKKIAESFNLIGLLAVEFFITETQELIVNEIAPRPHNSGHWSLDACNVSQFEQLVRAICGLPLQPVKLLFPCTMYNILGEDIYKYYKHHTQINESVYIYGKNKASQNRKMGHINILQY

SEQ ID NO: 13842 - DNA, 1137 bp, Neisseria gonorrhoeae FA 1090
  CDS (1)..(1137): transl_table=11
atgaacacaccccccatccttcctcccgccatgctcggcatcctcggcggcggacaattaggcagaatgtttgccgttgccgctaaaaccatgggctacaaagtaaccgttctcgatcccgacccgaatgcgccggcggcggaatttgccgaccgccatttgtgcgcgccgtttgacgaccgggccgcgttggacgaattggcaaaatgcgcggcggttacgaccgaatttgaaaacgtcaatgccgacgcgatgcgctctctggcaaagcataccaacgtttcccccagcggcgactgcgtgtccattgcacaaaaccgcattcaggaaaaagcgtggatacgcaaagcaggcttgcaaaccgcgccgtatcaggcggtttgcaaggccgaagacattactgaagcaagcgcgcaatttttgcccggcatcctgaaaacggctacgttgggctacgacggcaaaggtcaaatccgcgtcaaaacgttggacgaactcaaagccgcgtttgccgaacacggcggcgtggattgcgttttggaaaaaatggtggacttgcgcggcgagatttccgtgatcgtatgccgtctgaacgatgaaaacgtgcaaaccttcgaccccgccgaaaacatccacgaaaacggcatcttggcttattccatcgtccccgcgcggctgagtgccgacgtgcagcaacaggcgcggcagacggcgcaacgcttggcggacgaattggattatgtcggcgtattggcggtagaaatgtttgttgtcggcgacacacatgaattgctcgtcaatgaaaccgccccgcgcacgcacaattccggccaccatacgatagatgcctgcgccgcagaccagttccaacagcaggtacgcattatgtgcaacctgccgcccgccgacaccaaattattatccccttgctgtatggcgaatattttgggcgacgtttggcaggaagatggcggcgaaccggattggctgccgttgcaaagccggccgaatgcacacctgcacctatacggaaaaaaaaccgcacagaaaggtcggaaaatgggacactttaccgttttgaccaccgattcggacaccgcatttcaagaagcaaaaaaactgcatcagtccctataa

SEQ ID NO: 13843 - protein, 378 aa, Neisseria gonorrhoeae FA 1090
MNTPPILPPAMLGILGGGQLGRMFAVAAKTMGYKVTVLDPDPNAPAAEFADRHLCAPFDDRAALDELAKCAAVTTEFENVNADAMRSLAKHTNVSPSGDCVSIAQNRIQEKAWIRKAGLQTAPYQAVCKAEDITEASAQFLPGILKTATLGYDGKGQIRVKTLDELKAAFAEHGGVDCVLEKMVDLRGEISVIVCRLNDENVQTFDPAENIHENGILAYSIVPARLSADVQQQARQTAQRLADELDYVGVLAVEMFVVGDTHELLVNETAPRTHNSGHHTIDACAADQFQQQVRIMCNLPPADTKLLSPCCMANILGDVWQEDGGEPDWLPLQSRPNAHLHLYGKKTAQKGRKMGHFTVLTTDSDTAFQEAKKLHQSL

SEQ ID NO: 13844 - DNA, 1200 bp, Corynebacterium glutamicum ATCC 13032
  CDS (1)..(1200): transl_table=11
gtgacttctacaggaaaccaagcccacgctccaggaatgcccatcgtcgcagtaattggtgacggccaattagcccgcatgatgcagacctccgccatcgaactcggacaatcactgcgagttctagctggagcgccggattcctccgcagctcaagtagctgctgatgttgttctcggcgattacaccaacattgatgatctgcgcgtcgccatcgaaggcgccgatgtgatgaccttcgaccacgagcacgtccccaacgaacacctgcaccaactcatcgcagaaggcgtcaacgttcagccacgcccagaagcgctggtcaacgcacaagacaaacttgtcatgcgcaagcgtctacgtgaactcggcgcaccagtcccaccatttgctgccattgaatcagtcgaagatgcagtgggattcttcgaagcagttgatggccaagtttgcctcaaagcacgccgtggcggatacgacggcaagggcgtatggttcccagccgatgtagcagagcttcagtcgcttgtggcagagcttctcgacggcggcaccccactcatggcagaaaagaaagttgccctcaacagggaactgtccgccatggttgcccgcaccccaagtggagaaaccaaagcgtggccagtcgtagaatcagtgcagaagaacggtgtgtgtgcagaagcaatcgctcccgcacctgaactatccgcagaactgcaggaatccaccagaggattggcccagaagatcgccacggaactcggcgtcactggtgtcttggcagtggagctttttgaaaccctcgaccaaaacggccagccagagatctttgtcaacgagctcgccatgcgtccacacaacaccggccactggactcaagatggctgcgtgaccagccaattcgagcagcacctccgcgcagtcctcgactacccactgggtgctaccgacactttggctgattacaccgtgatggccaacgtgctcggtgccgacaccgacccagagatgcccatggcaacccgcatggtggaagtggggcgcaagtacccagatgccaagattcacctctacggcaagggacatcgcccgggacgaaagattggccacgtcaacatggtgggatccgaccttgaaaagacccgagccgaagccctggcctgcgcatacttccttgtcaacgctcgctgggattag

SEQ ID NO: 13845 - protein, 399 aa, Corynebacterium glutamicum ATCC 13032
MTSTGNQAHAPGMPIVAVIGDGQLARMMQTSAIELGQSLRVLAGAPDSSAAQVAADVVLGDYTNIDDLRVAIEGADVMTFDHEHVPNEHLHQLIAEGVNVQPRPEALVNAQDKLVMRKRLRELGAPVPPFAAIESVEDAVGFFEAVDGQVCLKARRGGYDGKGVWFPADVAELQSLVAELLDGGTPLMAEKKVALNRELSAMVARTPSGETKAWPVVESVQKNGVCAEAIAPAPELSAELQESTRGLAQKIATELGVTGVLAVELFETLDQNGQPEIFVNELAMRPHNTGHWTQDGCVTSQFEQHLRAVLDYPLGATDTLADYTVMANVLGADTDPEMPMATRMVEVGRKYPDAKIHLYGKGHRPGRKIGHVNMVGSDLEKTRAEALACAYFLVNARWD

SEQ ID NO: 13846 - DNA, 1083 bp, Pseudomonas syringae pv. syringae B728a
  CDS (1)..(1083): transl_table=11
atgaagatcggtgtaatcggtggcggccagctgggccgcatgttggcattggcaggtacgccgctgggcatgaacttcgcctttctcgatcccgcgccggacgcctgtgctgcggcacttggcgagcatctgcgtgccgattacggcgatctggatcatctgcgtcagttggcggatgaagtcgatctggtgaccttcgagtttgaaagcgttcccgccgagaccgtggcgtttctgtcacagttcgtaccggtctatccgagcgccgaggcgttgcgcattgcgcgtgatcgctggttcgaaaagagcatgttcaaggacctggacatcccgacgccggcattcgccgatatccagtcgcaggccgacctggatgccgcggtagccagcatcggtctgcctgccgtgctcaagacccgcaccctgggttatgacggcaagggccagaaggtcctgcgttcggcggccgatgtggtcgacacattcgccgagctgggcagcgtgccctgcctgctggagggcttcgtgccgttcagcggtgaagtgtcgttgattgccgtgcgtgcgcgtgatggcgagacccggttctacccgctggtgcacaacacgcatgacagcggcatcctgcgtctgtccatcgccagcaccgatcatcctttgcagtcactggccgaggactacgccggccgcgttctgaagcagctggattacgtgggtgtgctggcattcgaattctttgaagtcgacggtggcctgaaagccaacgagatcgcgccgcgcgtccacaactccggtcactggaccaccgaaggcgccgagtgcagccagttcgaaaaccacctgcgtgcggttgccggtctgccgctgggctctacggccaaggtcggtgaaagcgccatgctcaacttcatcggtgaagtgcccgcagtggacaaggtcatcgcggtcgaagactgccacctgcatcactacggcaaggccttcaaggctggccgcaaggtaggacacgccacggtccgcagcgtagaccgcgcaacgctggatcgtcaggtgaagttggtagagtcgctgatcaagggctga

SEQ ID NO: 13847 - protein, 360 aa, Pseudomonas syringae pv. syringae B728a
MKIGVIGGGQLGRMLALAGTPLGMNFAFLDPAPDACAAALGEHLRADYGDLDHLRQLADEVDLVTFEFESVPAETVAFLSQFVPVYPSAEALRIARDRWFEKSMFKDLDIPTPAFADIQSQADLDAAVASIGLPAVLKTRTLGYDGKGQKVLRSAADVVDTFAELGSVPCLLEGFVPFSGEVSLIAVRARDGETRFYPLVHNTHDSGILRLSIASTDHPLQSLAEDYAGRVLKQLDYVGVLAFEFFEVDGGLKANEIAPRVHNSGHWTTEGAECSQFENHLRAVAGLPLGSTAKVGESAMLNFIGEVPAVDKVIAVEDCHLHHYGKAFKAGRKVGHATVRSVDRATLDRQVKLVESLIKG

SEQ ID NO: 13848 - DNA, 1089 bp, Haemophilus influenzae 86-028NP
  CDS (1)..(1089): transl_table=11
atgcaaaactccaccttatacccaacggtttatgtacttggcaacggacaactcggcagaatgttaggttacgctggtgcacctttagatatttatgttgaacccttagccttcaatgcgccagtttttgacttacctgaaaatgcgatcatcacggcagaaattgaacgctgggaaaaaacacctttgactgaattactcggcaatcataaaaacttcgttaatcaacatgtatttggattattagccgatcgttttgctcaaaaatccttgcttgatgaactcaatctttctacctcgccttggtgtttattaaaagataaaacgcaatggaatgatgttttccaaactgttggcgagaaagtcgtcgtcaaacgtagaacaggcggatatgatgggcgtggtcaatggattatcagcgatgaaaacaaagcggacatcactgatgacttatttggtgaagtgatcgcagaaaaatttattccttttgattatgaagtttctattgtaggcgcaagatttaaaaatggcgaaaagcgtttttatcccgttacgcataacctgcaacaaaatggtattttgcgttacagtgtgattgataatgcatttcctcaacaatccgcacaacaaaaacaagctgaaacaatgctcggcaaaattatggataagttaggctatgtgggtgtgatggcaatggaatgttttgttgtaggcgacaaattactaattaacgaacttgcgcctcgcgtacataacagtggacattggacacaactgggatgtgctattagtcaatttgaattacatttacgcacgctacttgatttgccaacacctgacttacaaatttttgccccaagtgtaatggtaaatttaatcggcacaaaccataatccaaaatggcttaatataccttttgcacaacttcattggtacggtaaagaagtgagggctgggcgtaaggttgggcatatcaatctttctcatcctaataaagcggtcattattcaacaattagaaaagctccgaattgaattacccgaagattatcaatcaggattaaattgggcgattgaaaaactaaaataa

SEQ ID NO: 13849 - protein, 362 aa, Haemophilus influenzae 86-028NP
MQNSTLYPTVYVLGNGQLGRMLGYAGAPLDIYVEPLAFNAPVFDLPENAIITAEIERWEKTPLTELLGNHKNFVNQHVFGLLADRFAQKSLLDELNLSTSPWCLLKDKTQWNDVFQTVGEKVVVKRRTGGYDGRGQWIISDENKADITDDLFGEVIAEKFIPFDYEVSIVGARFKNGEKRFYPVTHNLQQNGILRYSVIDNAFPQQSAQQKQAETMLGKIMDKLGYVGVMAMECFVVGDKLLINELAPRVHNSGHWTQLGCAISQFELHLRTLLDLPTPDLQIFAPSVMVNLIGTNHNPKWLNIPFAQLHWYGKEVRAGRKVGHINLSHPNKAVIIQQLEKLRIELPEDYQSGLNWAIEKLK

SEQ ID NO: 13850 - DNA, 1083 bp, Pseudomonas fluorescens Pf-5
  CDS (1)..(1083): transl_table=11
atgaagatcggtgtaatcggtggcggccagctgggccgcatgttggccctggcggggactccgctgggaatgaacttcgctttcctcgacccggcgccggacgcctgtgccgccgccctcggtgaacacctgcgggccgactacggcgaccaggaccacctgcgccagctggccgatgaagtggacctggtgaccttcgaattcgagagcgtgccggcggaaaccgtggccttcctctcgcagttcgtgccggtctacccgagcgccgaagccctgcgcatcgcccgcgatcgctggttcgagaagagcatgttcaaggacctggggattcctactccggagttcgccgacatccagtcccaggcggatctcgacgccgccgtggcgcgcatcggcctgccggccgtgctcaagacccgcaccctgggttacgacggcaagggccagaaggtcctgcgcagcgccgccgacgtcgaaggcaccttcgccgaactgggcagcgtgccttgcctgctggaaggcttcgtgcccttcaccggtgaagtctcgctgatcgccgtgcgcgcccgtgacggtgaaacccgtttctacccgctggtgcacaacacccacgacagcggcatcctgcgcctgtcggtggccagcagtgaccacccgttgcaggccctggccgaggactactccagccgcgtgctcaagcagttggattacgtcggcgtaatggctttcgagttcttcgaagtggacggcggcctcaaggccaacgagattgctccgcgggtgcacaactccgggcactggaccaccgaaggcgccgagtgcagccagttcgaaaaccacctgcgggcggtggccggcctgcccctgggctccacggccaaggtcggtgagagcgccatgatcaacttcatcggcgaagtgccgccggtggacaaggtcatcgccatcgacgactgccacctgcaccactacggcaaggccttcaaggtcggtcgcaaggtcggccacgccaacctgcgctgcgccgatcaggctaccctgcaagcgcagatcctcaaggtgcaagcgctgatcgccgagtaa

SEQ ID NO: 13851 - protein, 360 aa, Pseudomonas fluorescens Pf-5
MKIGVIGGGQLGRMLALAGTPLGMNFAFLDPAPDACAAALGEHLRADYGDQDHLRQLADEVDLVTFEFESVPAETVAFLSQFVPVYPSAEALRIARDRWFEKSMFKDLGIPTPEFADIQSQADLDAAVARIGLPAVLKTRTLGYDGKGQKVLRSAADVEGTFAELGSVPCLLEGFVPFTGEVSLIAVRARDGETRFYPLVHNTHDSGILRLSVASSDHPLQALAEDYSSRVLKQLDYVGVMAFEFFEVDGGLKANEIAPRVHNSGHWTTEGAECSQFENHLRAVAGLPLGSTAKVGESAMINFIGEVPPVDKVIAIDDCHLHHYGKAFKVGRKVGHANLRCADQATLQAQILKVQALIAE

SEQ ID NO: 13852 - DNA, 1356 bp, Psychrobacter arcticus 273-4
  CDS (1)..(1356): transl_table=11
atgaccatagcgaacgcttaccctgttactcaaaccatccgtaccatcggaattttaggcggtggtcagctcggcatgatgctggcgcaagcggcgatgccattgggctatcaatgtgtgtttttagaagacagcgctgactgtcccgccagtttatacggacgcgtttttaccagtgagcaattagacgcttttattgaagctgctgatgtctttactctggagtttgagaataccccgactgcgactgttgagcaattggcaaacttatcaaaatctggcaaaaaacaagggatgttcccgccaacgattgcgctagatatcgcgcaagatcgtttaaaagaaaagcagatgtttaatacgcttgatatcgcaacggtgccttttatgcccgtcagttcagaggcagagttacagcaagcctgtcatgagcttggactgcctgtcgtgctaaaaaccagccgaggcggttatgatggtaaaggtcaatttgtgattaaagccgacagcgatatcaaagcagcttggcaagagctcaaggatgcggttacaggtaaaggctcactgacacaaacgccagcaccattaattgcagaaggctttattcactttagccgtgagctttctatcatcgccgcacgaggacaaaacggtcaagtacgctgttatgatttggtcgaaaaccatcatcatcagggtatcttggccaagacccaagcgccagccattggtaccagtcatttattcaagcaagcgactgatgccattaccaaagtcatgaatcatttggactatgttggagtgatggcgcttgagctatttgtgactaaagatgctcgtggtaatgacactttactggctaacgagatagcaccacgcgttcataattctggacactggagtattgagggtgctgtcaccagccaatttgaaaatcatattcgtgccgtggtcaatctaccactaggcgatactgataatgtccatccagcaattatgatcaatatcttagggcaatatcctgatattagcgcggtgctcaatattgatggcgtccattatcacagctatcataaagcggagcgcaatgaccgaaaaattgcccatattaccttgatgccaaacgatgtggcagacttagagcccgcactagccaagctggtcgccatactacctaataaagtcggtcttgataagaaagtaacacccatcaacaatccgacaacggcagaagatagcttaactactgctgaagtagagactaacgctgaaaataaaaaaagctcagcaaataatgacaatgagcagcaaattgctgagctagctaacccaaaagtagaaaaggctaagaaataa

SEQ ID NO: 13853 - protein, 451 aa, Psychrobacter arcticus 273-4
MTIANAYPVTQTIRTIGILGGGQLGMMLAQAAMPLGYQCVFLEDSADCPASLYGRVFTSEQLDAFIEAADVFTLEFENTPTATVEQLANLSKSGKKQGMFPPTIALDIAQDRLKEKQMFNTLDIATVPFMPVSSEAELQQACHELGLPVVLKTSRGGYDGKGQFVIKADSDIKAAWQELKDAVTGKGSLTQTPAPLIAEGFIHFSRELSIIAARGQNGQVRCYDLVENHHHQGILAKTQAPAIGTSHLFKQATDAITKVMNHLDYVGVMALELFVTKDARGNDTLLANEIAPRVHNSGHWSIEGAVTSQFENHIRAVVNLPLGDTDNVHPAIMINILGQYPDISAVLNIDGVHYHSYHKAERNDRKIAHITLMPNDVADLEPALAKLVAILPNKVGLDKKVTPINNPTTAEDSLTTAEVETNAENKKSSANNDNEQQIAELANPKVEKAKK

SEQ ID NO: 13854 - DNA, 1158 bp, Colwellia psychrerythraea 34H
  CDS (1)..(1158): transl_table=11
atgaataaaattctcatacttggcgcaggtcaattagctcgaatgatggagttagcaggcacacctttaaacttagatattaaagcactagatgtatcaagtaataaggttgtacaaccactttcacctgaaaatatttatggcgatttagaagcaggcattaaaaatgctgatgtaattaccgccgaatttgagcatattgcccatgacatacttgctgagtgtgagcaatcagggaagttatacccgacaagtaacgctattaaaattggtggcgatagacggttagagaaagcattgcttgaatcttgtaatgccgctaatgccaaacattactttgttaacgctaaaatagattttgataaagcaattgagcacttatctttacctattatctttaagactgcacttgaggggtatgatggaaaagggcaatggcgattaaagtcagcggctgatgctgaagtaatctggcaagatatggcaaactttcttgcggcttcaaaaaccactgttaagcaaggaattgttgctgaacaaatggtgccttttgatcgcgaagtatcgcttgttggtgttcgtcgcgttaatggagacgttgccgtgtatcctttaactgaaaatcatcatactaatggtattttaagtgtctcagtcgctgctcctgttaatgaacaattacagcaacaagccagtaccgtatttaaggccttatcagatgaactcgattatgttggtgttatggctattgagtttttccaagttggcgaccaactcttagtcaatgaaattgcaccaagggttcataactctggacattggactcaacaaggtgctgacacctgtcagtttgaaaaccacttaagggccatctgtgatttgcctttaggtagtacagcacttattcgtccaacagcaatggtcaacattattggtgaagatactgtttctaatgaggtgcttgctatacctagcgcaactattcattggtataacaaaggtaaacgtgtagggcgtaaaatgggtcatataaatgttagcggtgaaagtgaattacagcttgctcaacgtttacaacatctagctgatatcctttgcaaagaagcatttcctgatcttaatgacttcgcaaaaaactatttagataaacaaagctaa

SEQ ID NO: 13855 - protein, 385 aa, Colwellia psychrerythraea 34H
MNKILILGAGQLARMMELAGTPLNLDIKALDVSSNKVVQPLSPENIYGDLEAGIKNADVITAEFEHIAHDILAECEQSGKLYPTSNAIKIGGDRRLEKALLESCNAANAKHYFVNAKIDFDKAIEHLSLPIIFKTALEGYDGKGQWRLKSAADAEVIWQDMANFLAASKTTVKQGIVAEQMVPFDREVSLVGVRRVNGDVAVYPLTENHHTNGILSVSVAAPVNEQLQQQASTVFKALSDELDYVGVMAIEFFQVGDQLLVNEIAPRVHNSGHWTQQGADTCQFENHLRAICDLPLGSTALIRPTAMVNIIGEDTVSNEVLAIPSATIHWYNKGKRVGRKMGHINVSGESELQLAQRLQHLADILCKEAFPDLNDFAKNYLDKQS

SEQ ID NO: 13856 - DNA, 1083 bp, Pseudomonas syringae pv. phaseolicola 1448A
  CDS (1)..(1083): transl_table=11
atgaagatcggtgtaatcggtggcggccagctcggccgcatgttggcattggcaggtacgccgctgggtatgaacttcgcctttctcgatcccgcgccggatgcctgtgctgctgcacttggcgagcatctgcgtgccgattacggcgatctggaccatctgcgtcagttggctgatgaagtcgatctggtgactttcgagttcgaaagcgttccggccgagaccgtggcgtttctgtcgcagttcgtaccggtctatccgagcgccgaggcgttgcgcattgcgcgtgaccgctggtttgaaaaaagcatgttcaaggatctgggcattccgacgcccgcattcgccgatattcagtcgcaggccgatctggatgctgcggtggccagcattggcctgcctgcggtgctcaagacccgcacgctgggttatgacggcaagggccagaaggtcctgcgctcggcagcagacgtgaccgatacattcgccgagctgggcagcgtgccttgccttctggaaggcttcgtgccgttcactggcgaagtgtcgctgatcgccgttcgcgcacgtgatggcgagacccggttctacccgctggttcacaacacgcacgacagcggcatcctgcgcctgtccatcgccagcaccgatcacccattgcaggcactggccgaagactacgccggtcgtgtcctgaagcagctggattacgtgggcgtgctggcattcgagttctttgaggtcgacggcggcctgaaagccaacgagattgcgccgcgcgtccacaactccggtcactggacgaccgaaggcgccgagtgcagccagttcgagaaccacctgcgggcggttgccggtctgccgctgggctccacagccaaggtcggcgagagcgccatgctcaacttcatcggtgaagtgccagcagtggacaaggtcatcgccgtcgaagattgccacctgcaccactacggcaaggcgttcaaggctggccgcaaagtaggacacgctacgctccgcagcgttgaccgcgctacgctggatcgtcaggtgaagctggttgaagcgttgatcaagggctga

SEQ ID NO: 13857 - protein, 360 aa, Pseudomonas syringae pv. phaseolicola 1448A
MKIGVIGGGQLGRMLALAGTPLGMNFAFLDPAPDACAAALGEHLRADYGDLDHLRQLADEVDLVTFEFESVPAETVAFLSQFVPVYPSAEALRIARDRWFEKSMFKDLGIPTPAFADIQSQADLDAAVASIGLPAVLKTRTLGYDGKGQKVLRSAADVTDTFAELGSVPCLLEGFVPFTGEVSLIAVRARDGETRFYPLVHNTHDSGILRLSIASTDHPLQALAEDYAGRVLKQLDYVGVLAFEFFEVDGGLKANEIAPRVHNSGHWTTEGAECSQFENHLRAVAGLPLGSTAKVGESAMLNFIGEVPAVDKVIAVEDCHLHHYGKAFKAGRKVGHATLRSVDRATLDRQVKLVEALIKG

SEQ ID NO: 13858 - DNA, 1161 bp, Dechloromonas aromatica RCB
  CDS (1)..(1161): transl_table=11
atgccggtaaagtctgcaatgattcttcctccagctacccttggcatgctcggtggcggccagctcggccgcttcttcgtttcggccgcccacgaactgggctatcaggtctgggtgctcgatccggacaagaattcgccggccggccagatcgccgaacgccatttttgtgttgattacaacgactatgcggcgcttgacgagtttgccgccggttgtgccgcaatcaccaccgagtttgagaacgtgcccgccgatacgctggattatctagccaagttcgtgccggtacgcccgtcggcagcggccgtcggcatttgtcagaaccgcatcgccgaaaagtccttcctgcgcgacaacggcctgccgcacggtccattcgccgccatccgttgcgaagacgacattcgtaatgccgatgcctcgctgtttccggccatcctgaaagtggcccgcttcggctacgacggcaaggggcaggccacggtccataaccgcgaggaagcgctggtcgccttcggtcagttcaagggcgaacagtgcgtgctggaacagcgcctgacgctcgactacgaggtctcggtcgtcctcgcccgtgacgagcgcggccgggtcgcctgcttcccgaccggcgaaaatcagcacaccaagggcatcctcgacgtttccatcgtgccggcgcgcaccaccgcttgcgtcaagagtgatgccgaggaggtcgctgcccgtattgctgaaaagctcggctacatcggcaccatgggcgtcgagttcttcatcagccgcggccagttgatcgtcaacgaaatggcaccgcggccgcacaacagcggccactacaccattgacgcctgcgtgaccgaccagttcgagcagcaggtgcgtgccctgtgcggcttgccgcttggcgagccgcgggcgcactcggcctcggtcatggtcaatctgctcggtgacctttggtacgacggcgaaacctaccgcgagccggactgggccaagctgcatgccgtgcccaacttgaagctgcacctctacggcaagcaccacgcccgcccgggacgcaagatgggccacttcacggtgatcggggacaacgccgaggccgtgcaaaaggccgctctggctgcccgtgccgccatcggcatcagggacgaatga

SEQ ID NO: 13859 - protein, 386 aa, Dechloromonas aromatica RCB
MPVKSAMILPPATLGMLGGGQLGRFFVSAAHELGYQVWVLDPDKNSPAGQIAERHFCVDYNDYAALDEFAAGCAAITTEFENVPADTLDYLAKFVPVRPSAAAVGICQNRIAEKSFLRDNGLPHGPFAAIRCEDDIRNADASLFPAILKVARFGYDGKGQATVHNREEALVAFGQFKGEQCVLEQRLTLDYEVSVVLARDERGRVACFPTGENQHTKGILDVSIVPARTTACVKSDAEEVAARIAEKLGYIGTMGVEFFISRGQLIVNEMAPRPHNSGHYTIDACVTDQFEQQVRALCGLPLGEPRAHSASVMVNLLGDLWYDGETYREPDWAKLHAVPNLKLHLYGKHHARPGRKMGHFTVIGDNAEAVQKAALAARAAIGIRDE

SEQ ID NO: 13860 - DNA, 1158 bp, Thermobifida fusca YX
  CDS (1)..(1158): transl_table=11
gtgagcgagactaaccggaccgtccccgtcgtcggcatggtgggaggcggccaactcgcccggatgacccaccaggcggcgatcgcgctgggcgtggacttccgcgtcctggcggcccgccccaccgacagtgcggcgcgggtcgtcgccgacgtgcacctcggcgacgaccggggccgcgacgacctgctcgccttcgccaaagacagcgacgtggtgacgttcgaccacgagcacgtcccccagccggtgctgcgggaactccacgacgccgggatcgtgctgcgccccggcccggaagcgctgcaccacgcccaagacaagctggtcatgcgcacccggctgagcgaactcggcgccccctgcccgcggtggcgcggcatcaccagcctggacgaggtcaccgagttcgccgggcagaccggctggccggtggtgctcaaagcggcccgcggcggctacgacggcaaaggcgtgtgggtagtcggcgatgcagcagaggccgcggccgtcgtagagcgcgccgcccgcgagcaggtcccgctgctggtcgaagagaagatcgcgttccgccgggaactcgcggtccaggtcgcccgctccccctacggccaggtcgcggcctacccggtggtggagaccgtgcagcgcggcggaatctgccacgaagtgatcgctcctgccccccacctgtccgaagaccgggcggtggccgcccaggagctcgccatcgaactggccgctgcgttggacgtggtggggctgctcgccgtggaactgttcgaaaccgacacgggtgtcgtcgtcaacgagctggcgatgcggccgcacaactccggccactggacgatcgacggcgcctgcacgtcgcagttcgaacagcacctgcgggccgtcctggacctgcccctggggtcgccgcgcactgtggcccccttcacggtgatggcgaacctgctcggcgggcacgacccccacgtgttcaaccgctacattcatgtcatggcccgggacccggagctgaaagtgcacttctacggcaaagaagttcggcccggccgcaagatcggacacgtgaccgtggtcggggacgaccccgaagccctgctggagagagctagaactgccgccgcctacctcaagggagacgcacagtga

SEQ ID NO: 13861 - protein, 385 aa, Thermobifida fusca YX
MSETNRTVPVVGMVGGGQLARMTHQAAIALGVDFRVLAARPTDSAARVVADVHLGDDRGRDDLLAFAKDSDVVTFDHEHVPQPVLRELHDAGIVLRPGPEALHHAQDKLVMRTRLSELGAPCPRWRGITSLDEVTEFAGQTGWPVVLKAARGGYDGKGVWVVGDAAEAAAVVERAAREQVPLLVEEKIAFRRELAVQVARSPYGQVAAYPVVETVQRGGICHEVIAPAPHLSEDRAVAAQELAIELAAALDVVGLLAVELFETDTGVVVNELAMRPHNSGHWTIDGACTSQFEQHLRAVLDLPLGSPRTVAPFTVMANLLGGHDPHVFNRYIHVMARDPELKVHFYGKEVRPGRKIGHVTVVGDDPEALLERARTAAAYLKGDAQ

SEQ ID NO: 13862 - DNA, 1146 bp, Prochlorococcus marinus str. NATL2A
  CDS (1)..(1146): transl_table=11
atgattggggtcgtgggtggaggacagcttgcaatgcttttgattgaggctggaaagaaaagaaatgttgatgtcgttgttcagacggctgctaaaactgatcctgctgctaaaaagacaaagcaactcattttgcatgatcctacgaatcccgtgggtacaaaacttcttgcagaaaagacccgcttgattacttttgagaatgaatgggttgatatctcaagtttactttctcttgaaaataatggagtttcttttgtccctagacttcaatcaataagacctttaattaataaaataactcaaagagagctattaaacagtcttgatattccctgccctgattggttggctataccattaaaaaaatcaacagaaattgatcttcctgcagattggggatttcctttgatggcaaaagctgccaaaggtggatatgacgggaaaggaactaaaattattaaaaatctaaagcaacttcaagaatttctatcagttgaaagagaagggcaatggatgttagaaaaatggatctcttttgataaggaattatccatcgtttctagtagggattcaaaaggaattgtccgtagtctgccaatcgtagagacatatcaatctaaacaagtatgtgactgggtccttgctccagctgatattaatcatgacgttgatcttatggttagaaatatcgcagcctcgttgcttgctgagttgcaatatgttggagttattgctattgaatttttctatggatctgaaggattacttgtaaatgaaatagctccaagaactcataactcaggtcatttttctattgatgcttgtagcagcagtcagtttgatcaacaaatatgtatcacctctggtattaatgtacctatgcctgaaatgcttgttaatggtgctttaatggcaaacttgcttggtttgcaaagtaactatccaatatcacttacccaaagattggataatttgaggggtattcctggcttgaatgttcattggtatgaaaaagaggaagaaaaaaagggcaggaagctcggtcacgtcacatatctcttgaataataaggacgctttgtctagaaaaaaagaagcattagatgttttacaaaccatacggtcaatttggccgacctcttga

SEQ ID NO: 13863 - protein, 381 aa, Prochlorococcus marinus str. NATL2A
MIGVVGGGQLAMLLIEAGKKRNVDVVVQTAAKTDPAAKKTKQLILHDPTNPVGTKLLAEKTRLITFENEWVDISSLLSLENNGVSFVPRLQSIRPLINKITQRELLNSLDIPCPDWLAIPLKKSTEIDLPADWGFPLMAKAAKGGYDGKGTKIIKNLKQLQEFLSVEREGQWMLEKWISFDKELSIVSSRDSKGIVRSLPIVETYQSKQVCDWVLAPADINHDVDLMVRNIAASLLAELQYVGVIAIEFFYGSEGLLVNEIAPRTHNSGHFSIDACSSSQFDQQICITSGINVPMPEMLVNGALMANLLGLQSNYPISLTQRLDNLRGIPGLNVHWYEKEEEKKGRKLGHVTYLLNNKDALSRKKEALDVLQTIRSIWPTS

SEQ ID NO: 13864 - DNA, 1245 bp, Ralstonia eutropha JMP134
  CDS (1)..(1245): transl_table=11
atgccgaccgatatccatccctacctctccgaagcccacacgccggagtcgcgcgccgaatttggcgtcgacaaccccagcgcgcccatcctgcccggcgcctggctcggcatgctcggcggcggtcagcttggccgcatgttcacgcatgcggcgcagagcatgggctatcgcgtctgcgtgctcgacccggaccaggacagccctgccggctccgtggccgacaagcatatctgcgcaccctacaccgatgaggccgcgctcgccgagatggcaaagctgtgccaggccgtcagcacggaattcgaaaacgtgccatcgctatcgctggaccggctcgaacagctaggcgcctttgtcgcgccgcgcggctattgcgtgtcgattgcgcagaaccgcatcggcgagaagaagttctttgcctcgtgcgccgagcgtaccggcgtgccaaccgcaccgcactgggtgatccagcacgatgcggatgtcgaccagttgcccgacacggtgctgcccggcatcctcaagaccgcgcggatgggctacgacggcaagggccaggcccgcgtgaagacgcgcgaagacgtgcgcgcggcatggaaggccatgcagcacgtgccatgcgtgctcgagcagatgctgccgctggcctacgaggtctcggtgctggccgcacgcgccgccgatggcagcaccgccacctggccgctggccgagaacgtgcatcgcgacggcatcctgttctcgacggagatgccgtcggccagcgtgtcggccgacatcgccgaccgcgcccgtgccgccgccgcgaccatcgccacggaaatgggctatgtgggcgtgctgtgcatcgaattcttcgtgctcaccgacggctcgctgatcgccaatgaaatggcgccgcgtccgcacaactccggccacatcaccatggacgcgtgcgagaccagccagttcgagcaacaggtgcgtgccatggcccgcctgccgctgggcagcacgcgccagcattcggccggcaagatgctgaacctgcttggcgatgtatggttcgagttcggtttggagcgcacgccggcatgggatgaagtgctggcccagcccggcgccaagctgcacctgtacggcaagagcgacgcgcgcccgtcgcgcaagatgggccatgtgaactgcattggcgagcatgccgaggccgccgcgcaagcgttcgatgtcgctgcgaaggcgctgcacatcccgctctga

SEQ ID NO: 13865 - protein, 414 aa, Ralstonia eutropha JMP134
MPTDIHPYLSEAHTPESRAEFGVDNPSAPILPGAWLGMLGGGQLGRMFTHAAQSMGYRVCVLDPDQDSPAGSVADKHICAPYTDEAALAEMAKLCQAVSTEFENVPSLSLDRLEQLGAFVAPRGYCVSIAQNRIGEKKFFASCAERTGVPTAPHWVIQHDADVDQLPDTVLPGILKTARMGYDGKGQARVKTREDVRAAWKAMQHVPCVLEQMLPLAYEVSVLAARAADGSTATWPLAENVHRDGILFSTEMPSASVSADIADRARAAAATIATEMGYVGVLCIEFFVLTDGSLIANEMAPRPHNSGHITMDACETSQFEQQVRAMARLPLGSTRQHSAGKMLNLLGDVWFEFGLERTPAWDEVLAQPGAKLHLYGKSDARPSRKMGHVNCIGEHAEAAAQAFDVAAKALHIPL

SEQ ID NO: 13866 - DNA, 1092 bp, Ehrlichia canis str. Jake
  CDS (1)..(1092): transl_table=11
atgttacacaattcatatgttagccctggttccacaattggcatcataggtggaggacaattaggaaaaatgatatccatagctgcaacaaatctaggatataaaacacacctactaactgataatcaagatagtccatcaataaatgttactaacaatgtaacaatactagataactactacaataaagaattactgcttgaatttgcatctagtgttgacatcgcaacattagagtttgaaaatatacctagcactactatagacatattatcacagaaaaccaaagtttatccagggaaaacagccttacatatttctcaaaatagaataagagaaaaacaatatataagaaacttaggcattaaaacagcaaatttcagaataattgataactatgacaatttagtacacaatgttttggaattaggatatcctgcattacttaaaactacagaactaggttatgacggaaaaggtcaatacctaataacacagccaggtgatttaaatactctgtcaaccctcaattggcaacaggagtatattttagaaaaatttgttaaaatacataaagaaatatccattataatctcaaaaagtattaacggttccatagaatttttcccagtagcagaaaatcatcacactaatggcatcttagcaacatcatcagttcctgcatcaatttctgaagaaataaatatacaagcaaaaaatattgcattacaaattgcagaatctttcaatttagtaggcatactagcagtagaatttttcatcacagatgaacaagaacttatagtgaatgaaatagctcctcgtcctcataattctggccactggagtttagacgcttgtaatatcagtcaatttgaacaactaacaagggcaatttgtggcttgcctttaaagcctgtaaagttactttttccatgcactatggataatatactaggagatgatatatacaattactatcaatataaaactaagattaatgaaagcatatatatatatggcaagacaaaagctagtaaaaacagaaaaatgggtcacattaataggttaaatctaaaacatgagatatag

SEQ ID NO: 13867 - protein, 363 aa, Ehrlichia canis str. Jake
MLHNSYVSPGSTIGIIGGGQLGKMISIAATNLGYKTHLLTDNQDSPSINVTNNVTILDNYYNKELLLEFASSVDIATLEFENIPSTTIDILSQKTKVYPGKTALHISQNRIREKQYIRNLGIKTANFRIIDNYDNLVHNVLELGYPALLKTTELGYDGKGQYLITQPGDLNTLSTLNWQQEYILEKFVKIHKEISIIISKSINGSIEFFPVAENHHTNGILATSSVPASISEEINIQAKNIALQIAESFNLVGILAVEFFITDEQELIVNEIAPRPHNSGHWSLDACNISQFEQLTRAICGLPLKPVKLLFPCTMDNILGDDIYNYYQYKTKINESIYIYGKTKASKNRKMGHINRLNLKHEI

SEQ ID NO: 13868 - DNA, 1155 bp, Thiobacillus denitrificans ATCC 25259
  CDS (1)..(1155): transl_table=11
atgtcgaatgaggcgcagccgacgatgactgccctgccgatcctgccgggtgcgacgctcggcatcctgggaggcggtcaactcggccgcatgttcacgatcgccgcacgcaccatgggctacaaggtcatggtgctcgatcctgacttcgcgagtccggccgggcagatggccgacgtccacctgcaggccgactacaccgaccacggcgccctgcgccagctcggcgcggcctgcgccgcggtgacgaccgaattcgagaacgtaccggcacaaagcctgatagaactcgcgaaccattgccgggtctcgcccggtgccgccgcagtcgcgatcgcgcaggaccgcagccacgagaaatcctggctcgcgcagaacggtttcgcgacggcgcccttcgcgctggtgtacagcgaaggcgacctcgatgcggcgctcgccgaggtcggcacccccgcgctgctcaaggtcgcgcgcttcggctacgacggcaagggacaggcgcgcgtcaccgaccgcgacggcgcgcgcgcggctttcgccgaattcggtgcccagccctgcgtgctcgaaggcttcgtcaagctcgaaggcgagctatcggtcgtcctcgcgcgcgacgacgcggggcattgcgcgaccttccccgtcgccgaaaaccgccacgagcagggcatcctcgacgtctcgatcgtccccgcccgtgtcgccgattcgctcgccgatgccgcgcgcacgatggcgcaagacatcgcaggaaaactcgcctacgtcggcgtcatggcggtcgagttcttcgtcgtcgacggtcgcctgctcgtcaacgagatcgccccgcgcccgcacaactcggggcattacacgctcgacgcctgcgtcaccgaccagttcgagcagcaggtgcgcgcgctatgcggcctgccgctcggcgacacgcgcctgctctcgccggtcgcgatggtcaacatactcggcgaccgctggcacgacggcgggccgcactggtcggcgctgctcgcgcatccggcgatcaagctgcatctgtacggcaaggagaccgcgcgccccggccgcaagatggggcacttcaacgtgctcgacacggacgtcgaggcagcgctgaaactcgccgaagcgatgcgcgatgcgctctag

SEQ ID NO: 13869 - protein, 384 aa, Thiobacillus denitrificans ATCC 25259
MSNEAQPTMTALPILPGATLGILGGGQLGRMFTIAARTMGYKVMVLDPDFASPAGQMADVHLQADYTDHGALRQLGAACAAVTTEFENVPAQSLIELANHCRVSPGAAAVAIAQDRSHEKSWLAQNGFATAPFALVYSEGDLDAALAEVGTPALLKVARFGYDGKGQARVTDRDGARAAFAEFGAQPCVLEGFVKLEGELSVVLARDDAGHCATFPVAENRHEQGILDVSIVPARVADSLADAARTMAQDIAGKLAYVGVMAVEFFVVDGRLLVNEIAPRPHNSGHYTLDACVTDQFEQQVRALCGLPLGDTRLLSPVAMVNILGDRWHDGGPHWSALLAHPAIKLHLYGKETARPGRKMGHFNVLDTDVEAALKLAEAMRDAL

SEQ ID NO: 13870 - DNA, 1143 bp, Anabaena variabilis ATCC 29413
  CDS (1)..(1143): transl_table=11
atgaagcgtgtaggtgtaattggtggcggacagctggcctggatgatgggaggcgcagcgaataaattaggggttgaattgatagtgcagactcctagcagtaatgatcctgccgtatctattgctcaggatattgttttggcaaatattgatgatgcttatgctacagagattttagctcagaagagtgatgttatcacatttgaaaacgaattcgtcaatctagaggctttatctttattagaaattcaaggtgtttgtttccgtccaaagttagacgctttgtcacctctattagataaatatcatcaacgttgttatttaaaagatttaggtttacctgttccgcaattttatgcactagaaaaccaagaaaatctgatatctaaaatagatggtttgggttttcccttagtgttgaaatctcgccgccacggttatgacggacaaggtacttttatcattcgtgatttagcgacgttagaagagaaaatagacttaaataacaagacaaacactacatatttaatagaagaatttatcccctttgaacgggaactagctgtaattgctgcccgttctgtagatggagaaattgtcatctatcctgtagtagaaacacagcaagaacaacaagtatgtagacgagtcatagcacctgctcatattacacccaatcaagccgcagcagcagaagcgatcgcctctacactattaaatagtctggaagtggttggtgtgtttgggatcgagttatttctcaccgccgatggtcgagtcttagtcaatgaaatcgccccccgtacccacaactctggtcatttttctctagatgcgtgtgcaacatcccaatttgagcaacacctgagagccgtttgtggactaccgttaggaaacccatcattgcaatgcgctggtgcagttatggtcaacctgttaggctatgaaaactcccaaagtgattaccaaagccagcgccaacaactagcggccattccccaagctcacgtttattggtacggcaaaacagaatctcgcccagggcgaaaactcggacacgtcacagttttgttaaataatcataaccaaaccaccgcccaggaactcgctcaaaccgtagaatccatctggtatcccagttag

SEQ ID NO: 13871 - protein, 380 aa, Anabaena variabilis ATCC 29413
MKRVGVIGGGQLAWMMGGAANKLGVELIVQTPSSNDPAVSIAQDIVLANIDDAYATEILAQKSDVITFENEFVNLEALSLLEIQGVCFRPKLDALSPLLDKYHQRCYLKDLGLPVPQFYALENQENLISKIDGLGFPLVLKSRRHGYDGQGTFIIRDLATLEEKIDLNNKTNTTYLIEEFIPFERELAVIAARSVDGEIVIYPVVETQQEQQVCRRVIAPAHITPNQAAAAEAIASTLLNSLEVVGVFGIELFLTADGRVLVNEIAPRTHNSGHFSLDACATSQFEQHLRAVCGLPLGNPSLQCAGAVMVNLLGYENSQSDYQSQRQQLAAIPQAHVYWYGKTESRPGRKLGHVTVLLNNHNQTTAQELAQTVESIWYPS

SEQ ID NO: 13872 - DNA, 1092 bp, Streptococcus agalactiae A909
  CDS (1)..(1092): transl_table=11
atgaactcatttaagaccattgggattattggtggtggtcagctggggcagatgatggcgattgcggctatctacatgggccacaaggtcattacgctggatcctgctagcgactgccctgcctctcgcgttagcgaggtggttgtggcgccttacgatgatgttgaggctttgggacaattggctgcgcgttgcgatattttgacctatgagtttgagaatgtcgatgccgacggtctggatgccgttgtgtcagctggtcatctaccgcaggggactgatctgctccgcatttcccaaaatcgtatctttgaaaaagactttctggcaaataaggctggtgtgactgtcgctccctataaggtggtgacgtctagccttgatctagaggggattgacttgaccaagacctatgtcctcaagacagcgacaggtggttatgacggtcatgggcaaaaggttatccgctcagcagaagacctgtcagaggcgcagcaattagccaactcagctcagtgtgtcttggaagagtttgtcaacttcgaccttgaaatctcagtcatcgtgtctggaaatggtcaggatgtgacggtctttcctgttcaggaaaatatccaccgcaacaatatcctgtcaaaaaccatcgtaccagctcgcatctcagaccaactagctgacaaggctaaagaaatggcggtgcagattgccaagaaactccagctatcaggaactctctgtgtggaaatgtttgcgaccgcagacgacatcattgtcaacgaaatcgctccacgccctcacaactcaggacactactctatcgaagcctgcgacttttcacagtttgacacccacatcttgggcgtactggggcaacctctcccaccaatcaagcttcatgctccagccgttatgctcaatgtcctcggacaacatgtccagcaggcaattgactatgttgccgaaaaccctagcgcccacctccacatgtatggtaaactagaagcgaaacacaaccgcaaaatgggacatgtgacagtgtttagtaatacacctgatgaggtggaagagtttgaagaaaggatggatttctaa

SEQ ID NO: 13873 - protein, 363 aa, Streptococcus agalactiae A909
MNSFKTIGIIGGGQLGQMMAIAAIYMGHKVITLDPASDCPASRVSEVVVAPYDDVEALGQLAARCDILTYEFENVDADGLDAVVSAGHLPQGTDLLRISQNRIFEKDFLANKAGVTVAPYKVVTSSLDLEGIDLTKTYVLKTATGGYDGHGQKVIRSAEDLSEAQQLANSAQCVLEEFVNFDLEISVIVSGNGQDVTVFPVQENIHRNNILSKTIVPARISDQLADKAKEMAVQIAKKLQLSGTLCVEMFATADDIIVNEIAPRPHNSGHYSIEACDFSQFDTHILGVLGQPLPPIKLHAPAVMLNVLGQHVQQAIDYVAENPSAHLHMYGKLEAKHNRKMGHVTVFSNTPDEVEEFEERMDF

SEQ ID NO: 13874 - DNA, 1083 bp, Pseudomonas fluorescens PfO-1
  CDS (1)..(1083): transl_table=11
atgaaaatcggtgtaatcggtggcggccagttgggtcgcatgttggccctggcgggcaccccgctgggcatgaacttcgctttcctcgaccctgcgccggacgcttgcgccgctgcgctgggcgaacacctgcgggccgattacggcgatcaggatcacctgcgtcaattggccgatgaagtcgatctggtgaccttcgagttcgaaagcgtcccggcggaaaccgtggcgttcctttcgcagttcgtgccggtctacccgagcgctgaagccctgcgcatcgcccgcgaccgctggttcgaaaagagcatgttcaaggacctggggattccgaccccagcgttcgccgacatccagtcgcaagccgacctggacgccgccgttgcgtcgatcggcctgccggccgtcctgaaaacccgcaccctgggttacgacggcaagggccagaaagtcctgcgcaagccggaagatgtggtcggtaccttcgccgaactgggcagcgtgccttgcctgctggaaggcttcgtgccattcactggcgaagtgtcgctgatcgccgtgcgcgcccgcgatggcgagacgaagttctatccactggtgcacaacacccacgacagcggcatcctcaagctgtcggtcgccagctccgatcacccgctccaggccctggccgaagattattccagccgcgtgctcaaacagctggattatgtcggtgtgatggcgttcgagttctttgaagtcgacggcggcctcaaggccaacgaaatcgcaccgcgcgtgcacaactccgggcactggaccaccgaaggcgccgagtgcagccagttcgaaaaccacctgcgggccgttgccggtctgccgctgggttcgaccgccaaggtcggcgagagcgcgatgctcaacttcatcggcgttgttccgccggttgaaaaagtcatcgccatcgacgattgccacctgcatcactacggcaaggccttcaaggccgggcgcaaggtcggtcacgccaacctgcgctgcaaggacaaggcgaccctcgagcaacagattctcaaggtcgaagcgctgatcgccgagtaa

SEQ ID NO: 13875 - protein, 360 aa, Pseudomonas fluorescens PfO-1
MKIGVIGGGQLGRMLALAGTPLGMNFAFLDPAPDACAAALGEHLRADYGDQDHLRQLADEVDLVTFEFESVPAETVAFLSQFVPVYPSAEALRIARDRWFEKSMFKDLGIPTPAFADIQSQADLDAAVASIGLPAVLKTRTLGYDGKGQKVLRKPEDVVGTFAELGSVPCLLEGFVPFTGEVSLIAVRARDGETKFYPLVHNTHDSGILKLSVASSDHPLQALAEDYSSRVLKQLDYVGVMAFEFFEVDGGLKANEIAPRVHNSGHWTTEGAECSQFENHLRAVAGLPLGSTAKVGESAMLNFIGVVPPVEKVIAIDDCHLHHYGKAFKAGRKVGHANLRCKDKATLEQQILKVEALIAE

SEQ ID NO: 13876 - DNA, 1083 bp, Rhodobacter sphaeroides 2.4.1
  CDS (1)..(1083): transl_table=11
atgactgaccgcctgccccccggctcgaccatcggcatcctcggcggcggccagctcggccggatgctttcggtcgcggcggcgcggctgggcttccgcacccatatcttcgagccgagcgccaacccgcccgccgccgacgtggcccatgcggtcacgaccgcgccctacgaggacgaggccgcactgcgggccttcgcgacctcggtcgatgtcatcacctacgaattcgagaacatcccgacctcggccctcgacctgctggaggcgctgaaacccctccacccgaaccgccgcgccctcgcggtcagccaggaccggctcgaggagaagggcttcctgaccgggctcggcctcgccgtggccccctaccgccccgtcggcagccgagaggatctcgaggccgcgatccacggcatcggcacgcccgccatcctcaagaccacgcgcctcggctatgacggcaaggggcaggcccgcctcatggagcccgacgacgcggccgaggccttcgcggccatgggcggccagcctgccgtgctcgagggcttcgtccgcttcacccacgaggtctcggtcatcgcggcgcgcggccgcgacggatcggtcgcggtctatgagcccggcgagaacgtgcatctctcgggcatcctgcacacgaccacggtgcccgcccgcctcaccgcctcgcagcgcaccgacgcggtgctgctggccgggcggatcctcaatgctctcgactatgtgggcgtgatgggggtcgagctcttcgtgacgcccgaggcgctgctggtgaacgagatcgcgccgcgggtccacaattccgggcactggacgcagaacggctgcgcggtggaccagttcgagcagcatatccgtgcgatcaccggctggccgctcggcgacggctcgcgcttcgccgatgtcgagatggagaatctgatcggccatgatgtggcccgggtgccggcgctcgcgctcgagaagcacacggcgatccatctctatggcaaggccgaagcgcgcccggggcgcaagatgggccatgtgaaccgcatcctccgcccggtgaccggcgcatga

SEQ ID NO: 13877 - protein, 360 aa, Rhodobacter sphaeroides 2.4.1
MTDRLPPGSTIGILGGGQLGRMLSVAAARLGFRTHIFEPSANPPAADVAHAVTTAPYEDEAALRAFATSVDVITYEFENIPTSALDLLEALKPLHPNRRALAVSQDRLEEKGFLTGLGLAVAPYRPVGSREDLEAAIHGIGTPAILKTTRLGYDGKGQARLMEPDDAAEAFAAMGGQPAVLEGFVRFTHEVSVIAARGRDGSVAVYEPGENVHLSGILHTTTVPARLTASQRTDAVLLAGRILNALDYVGVMGVELFVTPEALLVNEIAPRVHNSGHWTQNGCAVDQFEQHIRAITGWPLGDGSRFADVEMENLIGHDVARVPALALEKHTAIHLYGKAEARPGRKMGHVNRILRPVTGA

SEQ ID NO: 13878 - DNA, 1197 bp, Burkholderia sp. 383
  CDS (1)..(1197): transl_table=11
atgaccgcaactcctgattccgtttccccgatcctgcccggcgcgtggcttggcatggtcggcggtggccagctcggccgcatgttctgctttgctgcccagtcgatgggctatcgcgtcgccgtgctcgatcccgatccgacgagccccgccggcacggtcgccgaccgccacctgcgcgcggcctacgacgacgaagccgcactggccgaactggccgaactgtgcgaggcggtgtcgacggagttcgagaacgtgccggccgcgagcctcgatttcctcgcgcgcacgacgttcgtcgcgccggccggccgctgcgtcgcggtcgcgcaggaccggatcgcggagaagcgcttcatcgaagcgtcgggcgtgcccgtggcgccgcacgtcgtgatcgaatcgtcggcggcactcgccgcgctcgacgatgccacgctcgacgcggtgctgccgggcatcctgaagacggcgcgccttggctacgacggcaagggccaggtgcgggtgagcaccgcgcaggaagcgcgcgacgcgcatgcggcgctgaacggcgtgccgtgcgtgctcgagaagcgcctgccgctgaaatacgaagtgtcggcgctgatcgcgcgcggcgcggacggccgctcggccgcgttcccgctcgcgcagaacgcgcaccacaacggcatcctcgcgctgacggtcgtgcccgcgccggccgccgatgcggcgcgcgtcgaagaggcgcagcaggccgccgtgcggatcgccgatacgctcggctacgtcggcgtgctgtgcgtcgaattcttcgtgctggaagacggttcgttcgtcgcgaacgagatggcgccgcgcccgcacaactccggccactacacggtcgatgcgtgcgcaacgagccagttcgagcagcaggtgcgcgcgatgacgcgcatgccgctcggcaatccgcgccagcattcgccggccgcgatgctgaacatcctcggcgacgtgtggttcccgaacggtgcggcggctgatgctgtcacgccgccgtgggacacggtcgcggcgatgcccactgcgcacctgcacctgtacggcaaggaagatgcgcgcgtcggccgcaagatgggccacgtgaacttcacggccgaaacgcgcgacgaagccgttgccgcggccaccgcgtgcgcgcagctgctgcgcgtgccgctcgactga

SEQ ID NO: 13879 - protein, 398 aa, Burkholderia sp. 383
MTATPDSVSPILPGAWLGMVGGGQLGRMFCFAAQSMGYRVAVLDPDPTSPAGTVADRHLRAAYDDEAALAELAELCEAVSTEFENVPAASLDFLARTTFVAPAGRCVAVAQDRIAEKRFIEASGVPVAPHVVIESSAALAALDDATLDAVLPGILKTARLGYDGKGQVRVSTAQEARDAHAALNGVPCVLEKRLPLKYEVSALIARGADGRSAAFPLAQNAHHNGILALTVVPAPAADAARVEEAQQAAVRIADTLGYVGVLCVEFFVLEDGSFVANEMAPRPHNSGHYTVDACATSQFEQQVRAMTRMPLGNPRQHSPAAMLNILGDVWFPNGAAADAVTPPWDTVAAMPTAHLHLYGKEDARVGRKMGHVNFTAETRDEAVAAATACAQLLRVPLD

SEQ ID NO: 13880 - DNA, 1161 bp, Synechococcus sp. CC9605
  CDS (1)..(1161): transl_table=11
atgatcggcgttgtgggaggtggtcagctggcacggatgcttgtgcaggccgccgcgcaacgcgaggttccgatcgccgttcagacagccaatccagcggatcccgccgctggattggcttcgcgtctcgtgtcggcggatccgcgggatgtggctggaacccgggagctggtggtgggctgtgacggcgtcaccttcgagaacgagtgggtcaacatcgacgcccttctgccgttggagcagcagggcgttcgtttccagccatccctggctgtgctctcgcccctggtcgacaagttgtcgcagcgtcagctgctcgacgatctggcgatcccaagcccgccctggtgtccgctgcgtttgatttcgccggcccaacctgcgcttcctcagggctggacctttcccgtcatggccaaggcctcccgcgggggatatgacgggaagggcacggtggtgttgcgcgatatcgatgccctgtcgcagttgttgcgagccgtccctgccgaggattggttgctggaatcctgggtggactatgaacttgagctggctctcgtggtcagccgcgatcagcgcggccggatccgccatttccctctggcgcagacccatcagcatcagcaggtttgtgactgggttctggcaccggcaccggtggacccttccgtagcggccttggcctacaacgttgctgcgtcgctgatgacgaagctcggctatgtgggggtgttggctctggagtttttctatggaccagctggcctgcaggtgaatgagatcgccccccgtacccacaattcaggccatttctcgatcgaagcctgcaccagcagtcagttcgatcagcagctctgcatcgcggctggtcttcccgtgcctgatcccgagctcaaaagccgcggtgccttgatggtcaacctgctgggcctggaccccgaacgccatgatcccttggaccagcggctccaggcgctggaagccatgccagggcttcacctgcactggtacggcaagtcaccggaaactccggggcgcaagttgggccacgtgacgctgctgctcgagactgaaacggtggcgatgcgtcgcgatgaggccgagtcagcacttgccgccattcgcaggatctggccccacgcgagcgagagtcaggactag

SEQ ID NO: 13881 - protein, 386 aa, Synechococcus sp. CC9605
MIGVVGGGQLARMLVQAAAQREVPIAVQTANPADPAAGLASRLVSADPRDVAGTRELVVGCDGVTFENEWVNIDALLPLEQQGVRFQPSLAVLSPLVDKLSQRQLLDDLAIPSPPWCPLRLISPAQPALPQGWTFPVMAKASRGGYDGKGTVVLRDIDALSQLLRAVPAEDWLLESWVDYELELALVVSRDQRGRIRHFPLAQTHQHQQVCDWVLAPAPVDPSVAALAYNVAASLMTKLGYVGVLALEFFYGPAGLQVNEIAPRTHNSGHFSIEACTSSQFDQQLCIAAGLPVPDPELKSRGALMVNLLGLDPERHDPLDQRLQALEAMPGLHLHWYGKSPETPGRKLGHVTLLLETETVAMRRDEAESALAAIRRIWPHASESQD

SEQ ID NO: 13882 - DNA, 1191 bp, Prochlorococcus marinus str. MIT 9312
  CDS (1)..(1191): transl_table=11
atgagtttaaaaagaaatataaacgatattaagaaaaattattccctaggaataattggaggcggtcaactggctttgatgttaaccgaggcagcacaaaaaagagatttagaagtatgtgtgcaaacaaaatcttgtgatgatcctgctggtttaaaagcagatcatgtcatagaagctgatcctttaaagataagaggtaataaatcgttaattaatgagtgtgaaaaaataatttttgaaaatgaatggataaaaattgataaattaaatttaattgataataacgatatttttgttccaagccttaatgcgattaagccattagtagataggttttctcaaaaaaaattaatagatagaatgaatattccctgtccaaaatggataagtattgaagattttaaaaatctcccttatgaggaaatcagtaattggagtttccctttaatggcaaaatcaaataaaggtggatatgacggtaaagggaacagaaaaataatgacaaaagaagatttagattcttttttaaaagagaataattctgatgaatggttaatagaagaatggatagagtatgaaaaggaactagctcttgttggttcgagagatagaaccggtaagataagattctttccaatcgttgagacattccaatcaaatcatgtttgtgattgggttcttgcacctgctactactgaatatgatttgaacttatttgcaataaatattttttcctcaatagtcaatgaacttaattatgttggagttttagctattgaattcttctatggagataatggtcttttaattaatgaaatagctccaagaacacataactcagcacatttctctattgaagcttgtacttcaagtcagtttgatcaatatgtttgcatttcttctgggataatgccacctgaaattaaaatgcactcagaaggggcaattatgataaatctactgggattaaaaaagaatttcccaatttcaatagaaacaagagttaaaatgttgtctgaaattgagggttctaatattcattgttatggtaaatctcgagaaattctggggagaaaaatggctcacattacatttttattgaacggtaaaacgcattcagaaagatatgatcaggcacaagttttattaactatggtaagagacatttggccatctccaaatacataa

SEQ ID NO: 13883 - protein, 396 aa, Prochlorococcus marinus str. MIT 9312
MSLKRNINDIKKNYSLGIIGGGQLALMLTEAAQKRDLEVCVQTKSCDDPAGLKADHVIEADPLKIRGNKSLINECEKIIFENEWIKIDKLNLIDNNDIFVPSLNAIKPLVDRFSQKKLIDRMNIPCPKWISIEDFKNLPYEEISNWSFPLMAKSNKGGYDGKGNRKIMTKEDLDSFLKENNSDEWLIEEWIEYEKELALVGSRDRTGKIRFFPIVETFQSNHVCDWVLAPATTEYDLNLFAINIFSSIVNELNYVGVLAIEFFYGDNGLLINEIAPRTHNSAHFSIEACTSSQFDQYVCISSGIMPPEIKMHSEGAIMINLLGLKKNFPISIETRVKMLSEIEGSNIHCYGKSREILGRKMAHITFLLNGKTHSERYDQAQVLLTMVRDIWPSPNT

SEQ ID NO: 13884 - DNA, 1095 bp, Rhodospirillum rubrum ATCC 11170
  CDS (1)..(1095): transl_table=11
atggccatggttggacggctggcggccttggggcctgtggggccgggcgcgcgattgggaattctgggcggtggccagcttggccggatgacggcgctggcggcggcccgccttggcatctcctgccacatcttcacccccgaggataacggaccggcctcgcaggtttgtccgatggtcaccctggcggcttacgacgacctagacgcgctgtcgcgcttcgccgcctcggtcgatgtcatcacctttgaattcgagaacatcccggcggccagcgtcgcccatctcgccgccttgcggccggtccgccccggctggaaagccctggaaaccgcccaggaccgcattcttgaaaagcgttttttcaacgatttggggatcgccacggccccctgggcgccggtcaccgacggcccgcagtccctggccgaggcggtggcgaagatcggctgtccggccattctcaagaccacgcgcctgggctatgacggcaaggggcaggtgcggctgaacgccccgggcgactcggcggcggcctgggctgccttgggcaaccggccggcggtgctcgaggggttggtgcccttcgtctccgagatctcggtgatcatcgcccgcgcccccgacggggcgacggcctgtttcgagccgacgttgaaccaccaccgcgagggcatcttgcatacctcgtcggtgcccgcgccgatccgtccgcaaacggcgatcgccgcccgcgccatcgccgagagcgccgccctggcccttgatctggtcgggctgctggccgtcgagttgttcgtgctggccgatggctcgttgttggtcaacgaaatggcgccgcgcccccacaacagcggtcattggacgatggacgcctgccacaccgatcaattcgagcaattcgtgcgcgccgtctgcggcctgcccttgggcgatccgtcccgcttccgggcgatgcggatgaccaatctgatcggcgacgaggtccatgactggccgcttctgatggcgacgccgggcgcccgcctgcacctgtatggcaaggtggaaagccgccggggccgcaagatgggccacgtcaatacgccggtgtag

SEQ ID NO: 13885 - protein, 364 aa, Rhodospirillum rubrum ATCC 11170
MAMVGRLAALGPVGPGARLGILGGGQLGRMTALAAARLGISCHIFTPEDNGPASQVCPMVTLAAYDDLDALSRFAASVDVITFEFENIPAASVAHLAALRPVRPGWKALETAQDRILEKRFFNDLGIATAPWAPVTDGPQSLAEAVAKIGCPAILKTTRLGYDGKGQVRLNAPGDSAAAWAALGNRPAVLEGLVPFVSEISVIIARAPDGATACFEPTLNHHREGILHTSSVPAPIRPQTAIAARAIAESAALALDLVGLLAVELFVLADGSLLVNEMAPRPHNSGHWTMDACHTDQFEQFVRAVCGLPLGDPSRFRAMRMTNLIGDEVHDWPLLMATPGARLHLYGKVESRRGRKMGHVNTPV

SEQ ID NO: 13886 - DNA, 1197 bp, Burkholderia thailandensis E264
  CDS (1)..(1197): transl_table=11
atgactgcactccccaacccgaattccccgatcctgccgggcgcctggctcggcatggtcggcggcggccagctcggccgcatgttctgcttcgccgcgcaggcgatgggctaccgcgtcgccgtgctcgatcccgatccgacgagcccggcgggcgccgtcgcggacaagcatctgcgcgccgcatacgacgacgaggccgcgctcgccgagctcgcgcaattgtgcgacgcggtatcgaccgagttcgagaacgtgcccgccgcgagcctcgatttcctcgcgcaatcgacgttcgtcgcgcccgccggccgctgcgtcgcgatcgcgcaggaccggatcgccgagaagcgtttcatcgcggcgtcgggcgtgccggtcgcgccgcacgtcgtgatcgagtcggccgcgcagctcgcggcgctcgccgatgcggatctcgccgcggtgctgcccggcatcctgaagaccgcgcgcctcggctacgacggcaaggggcaggtgcgcgtcgcgaccgcgcaggaagcgcgcgacgcgtatgggtcgctcggcggcgtgccgtgcgtgctcgagaagcgcctgccgctcaaatacgaggtgtcggcgctgatcgcgcgcggcgcgaacggcgcgtccgccgtgtttccgctcgcgcagaacacgcaccacggcggcatcctgtcgctgagcgtcgtgcccgcgcccgccgcgagcgatgcgctcgtgcgcgacgcgcagcaggcggccgcgcggatcgccgattcgctcgactacgtcggcgtgctgtgcgtcgagttcttcgtgctcgaagacggctcgctcgttgcgaacgaaatggcgccgcggccgcacaattccggccactacacggtcgatgcgtgcgagacgagccagttcgagcagcaggtgcgcgcgatgacgcggctgccgctcggcagcacgcgccagcattcgcccgccgcgatgcttaacgtgctcggcgacgtatggttcgcgagcggcgcgtcgggcgagcccgtcacgccgccgtgggaccaggtcgccgcgatgccgaccgcgcggctgcatctgtacggcaaggaagaagcgcgggtcggccgcaagatgggccacgtgaacttcaccgcggcgacgctcgacgaagcggtcgcgggcgcgaccgcgtgcgcgcggctgttgcgcattccgctcgactga

SEQ ID NO: 13887 - protein, 398 aa, Burkholderia thailandensis E264
MTALPNPNSPILPGAWLGMVGGGQLGRMFCFAAQAMGYRVAVLDPDPTSPAGAVADKHLRAAYDDEAALAELAQLCDAVSTEFENVPAASLDFLAQSTFVAPAGRCVAIAQDRIAEKRFIAASGVPVAPHVVIESAAQLAALADADLAAVLPGILKTARLGYDGKGQVRVATAQEARDAYGSLGGVPCVLEKRLPLKYEVSALIARGANGASAVFPLAQNTHHGGILSLSVVPAPAASDALVRDAQQAAARIADSLDYVGVLCVEFFVLEDGSLVANEMAPRPHNSGHYTVDACETSQFEQQVRAMTRLPLGSTRQHSPAAMLNVLGDVWFASGASGEPVTPPWDQVAAMPTARLHLYGKEEARVGRKMGHVNFTAATLDEAVAGATACARLLRIPLD

SEQ ID NO: 13888 - DNA, 1059 bp, Novosphingobium aromaticivorans DSM 12444
  CDS (1)..(1059): transl_table=11
atgatcccgcccggcgaaaccatcggtatccttggcggcggccagcttggccggatgatggcgctggcggctgccaacctcggctaccgctgccatgcctatgcgccagaggccgattcgattgccgcggatgtctgcgccgccttcacccagggtgcctatgacgacgaggcggcgctggcggcgtttgccgcgcagtgcgcggtcgtcacctacgagttcgagaatgtcgccgccgcgccgctcgccgcagtcagtgcccacgcgccgctccatccgcccgcccgcgcgctcgaagtggcgcaggacagggtgagcgagaagtcctttgtcgaagcgctgggcggccgccccgcgccgtgggcgcaggtcgattcgcttgaagatctcaaggccgccgtcgcccggatcggcgcgcccggcatcctcaagacccggcgcgacggctatgacggcaagggccagtggcgcatcgcccagcccggcgacgccgatgcgctcgatctttcggccaagccgctgatctacgaaggcttcgtcactttcgaagccgagttctcggtcatcctcgtgcgcaccgaggctggtgaggtgcgtttctgggattcggccgagaacgtccacaaggccggcatcctcgaccgctcgaccgtgccagccgcgccggtgatcctggcgcaggtggacgaggcccgcgcccttgccgcgcgggtggccgatgcgcttggctatgtcggcgttctcacgctcgaattcttcgccacggccgatggcccggtgttcaacgagatggcaccccgcgtgcacaactcgggccactggaccatcgagggcgcgctcaccagccagttcgagaaccacgttcgcgcgatttgcgggttgccgctgggctcgaccgcgctcgccgcgaagggggtggtcatggacaacctcatcggcgacgacgcgcacgactggcccgccatcctttccgacccggcgaaccacctccacctctatggcaaggcggcggtgcgacccgggcgcaagatgggccacgtcacccggctggtactgtga

SEQ ID NO: 13889 - protein, 352 aa, Novosphingobium aromaticivorans DSM 12444
MIPPGETIGILGGGQLGRMMALAAANLGYRCHAYAPEADSIAADVCAAFTQGAYDDEAALAAFAAQCAVVTYEFENVAAAPLAAVSAHAPLHPPARALEVAQDRVSEKSFVEALGGRPAPWAQVDSLEDLKAAVARIGAPGILKTRRDGYDGKGQWRIAQPGDADALDLSAKPLIYEGFVTFEAEFSVILVRTEAGEVRFWDSAENVHKAGILDRSTVPAAPVILAQVDEARALAARVADALGYVGVLTLEFFATADGPVFNEMAPRVHNSGHWTIEGALTSQFENHVRAICGLPLGSTALAAKGVVMDNLIGDDAHDWPAILSDPANHLHLYGKAAVRPGRKMGHVTRLVL

SEQ ID NO: 13890 - DNA, 1077 bp, Anaplasma phagocytophilum HZ
  CDS (1)..(1077): transl_table=11
atgcgaacatctgtctctcataatatgctatccgccaccagagtcggtattataggaggtggtcagctaggaaaaatgctttctctatcctcttctaagttaggctatcaaaccagtatctttgcagaaagcgcaattgatccagctgttttcgtcacgaactcttcagtaataggcagtttcagtgatacagagaaattgcggacctttgcttcaatggttgacgtagcagttatagaatttgaaaatattccagtatcagcggtgcatacacttcaagaaactatccctgtgtatcctggagttaaggcgctgcatgttgcacagaacagaatacgtgagaaaactcacatacagtcactaggtattgctgtagctgattttgccgttatacatagtcatacagatttgcataaggccgtgcaagatgttggcgtgccatctgtgctaaaaactgctgaatctggatatgatggaaaggggcaatacgtcctacgcagcactgaagatgtggggtcactagcccatttacctttggagcagggatacatattggaaagattgatcgagatagaaaaagagatatctataatcatagctgtcgatcgcaacgcttctcatacgttttttcctgtagcaaagaacacacacgtagatggcgtactgagtgaatcaattgttcctgctggtatatcgacagacctccagaaacaagctcaagagatcgcttatgctatagcaacgtcattagaaatggtgggcatacttgcagttgaattcttcatctcgaaaagcggtaagttgctagtgaatgaaattgctccacgtccacataattcaggtcactggagccaggatgcgtgtaatgttagccaatttgaacagctgatacgtattgcttgttggcttcccatgcgtgttgtacacctactaacaccgtgcgttatgcgaaatgtttttggagataacatcattgatgaggaaattcaccaagaccatcgcaatagcatctctctgtatgggaagcagcctcgcgctaaaagaaagatggggcatataaattcactgttatattaa

SEQ ID NO: 13891 - protein, 358 aa, Anaplasma phagocytophilum HZ
MRTSVSHNMLSATRVGIIGGGQLGKMLSLSSSKLGYQTSIFAESAIDPAVFVTNSSVIGSFSDTEKLRTFASMVDVAVIEFENIPVSAVHTLQETIPVYPGVKALHVAQNRIREKTHIQSLGIAVADFAVIHSHTDLHKAVQDVGVPSVLKTAESGYDGKGQYVLRSTEDVGSLAHLPLEQGYILERLIEIEKEISIIIAVDRNASHTFFPVAKNTHVDGVLSESIVPAGISTDLQKQAQEIAYAIATSLEMVGILAVEFFISKSGKLLVNEIAPRPHNSGHWSQDACNVSQFEQLIRIACWLPMRVVHLLTPCVMRNVFGDNIIDEEIHQDHRNSISLYGKQPRAKRKMGHINSLLY

SEQ ID NO: 13892 - DNA, 1050 bp, Neorickettsia sennetsu str. Miyayama
  CDS (1)..(1050): transl_table=11
atggacctttatagtaggaaaatgcagcgcattggaataatcggaggcggacagctaggaaaaatgacagccatagctgcatataacctgggttttaaagtttgtgtcctagcagagaaggagaactccccagctatagatgtagccagagattatgttgtttcacctttcctcgacaggtcagggattcttaactttgtagaacatgtagacgctataacatttgagagcgaaaacataccaacagagacgcttgatctactccacgataagttcgacgttccaaatactaaagcgattaaggtagcacaggacaggttcttagaaaaagaattcttaaggaaaaatggaataccaactaccgaatattggtacatcgaaaaggaggaggaccttgatagtgtagattttccagcaatattaaaaacaatcaatggtggctatgatggaaaaggacaattcctcctagaggatcatgattatgtaagaagagaagccggaaacctcaaattccctctaatagcagaaaagttatttaggataagtaaagaattctccataatagtttcgagaaatgaaactggaagtgtgtgttttccgatagcagaaaatgttcatgttaatggaatactcaaaacatccagcgtgccagctgtacttcctcatcatgtcgcacttgaaataaaaaacataggatttcaaatagcagatctattagaaataaagggtctcttgtgtgtagaattttttctcgacgaagataacaagctagttgtgaatgaaatcgctcctagaccacacaattctggtcactggagcatggattgctgcgacattgaccaatttgaagaactggttcttgcaattacaggtaataaactcaaaaagcctaatctcgtagttccgtgcacaatgaagaatattcttggcaatgaaataaatacttggaaagatttattcctacaaaaaaatgtaaaactctacaactatggtaaagaacagcctaaaatcctaaggaaaatggggcatataaacattctgcatccgtaa

SEQ ID NO: 13893 - protein, 349 aa, Neorickettsia sennetsu str. Miyayama
MDLYSRKMQRIGIIGGGQLGKMTAIAAYNLGFKVCVLAEKENSPAIDVARDYVVSPFLDRSGILNFVEHVDAITFESENIPTETLDLLHDKFDVPNTKAIKVAQDRFLEKEFLRKNGIPTTEYWYIEKEEDLDSVDFPAILKTINGGYDGKGQFLLEDHDYVRREAGNLKFPLIAEKLFRISKEFSIIVSRNETGSVCFPIAENVHVNGILKTSSVPAVLPHHVALEIKNIGFQIADLLEIKGLLCVEFFLDEDNKLVVNEIAPRPHNSGHWSMDCCDIDQFEELVLAITGNKLKKPNLVVPCTMKNILGNEINTWKDLFLQKNVKLYNYGKEQPKILRKMGHINILHP

SEQ ID NO: 13894 - DNA, 1086 bp, Ehrlichia chaffeensis str. Arkansas
  CDS (1)..(1086): transl_table=11
atgctacacgattcatacatcggccctggatcaactattgggattataggtggaggacagttaggaaaaatgatatccattgctgcagcaaacttaggatataaaacacatttattaactaataacccggatgatccatcagtctacattactaacagtgcaactatatcacacaattatcaaaatacagaatcattgcttgagtttgcatctaatgtcgacattgcaaccttagaatttgagaacattcctactactactatagatatattatcacaaaaaatcaaagtttatccaggaaaagaagctttatacatttcccaaaatagaataagagaaaaacagcacataagaaatttaggaatcaaaacttcagattttagagtaattgataactacaacagtttagtcaaaaatactatagaactaggatatcccaccttacttaagaccacagaattaggctacgatggaaaaggccagtatataataaaacaacaagatgatttaagtgctttatcaactctcaattgggaccaatcatatattttagaaaaatttgtcaaaatttataaagaaatatctgttataataacaaaaagcatcagtggttctatagaattttttccaactgcggaaaactgtcatactgatggtattttaaccacatcatcagtaccagccctaatctctcaagagataaatgtacaagcacaaaaaattgctttacaaattgcagaatctattaatttagtaggtttattagcagtggaatttttcataacagatacacaagaacttatagttaatgaaatagctccccgccctcacaactctggacattggagcttagatgcttgtaacatcagccaatttgaacaattaataagagcaatatgtggattacctttaaagcctgtaaaattactttttccatgtattatgaataacatattaggagataatatacacaactattataaacatgaaaccaaggttaatgaaaacttatacatatacggcaagaaaaaggccactaaaaacagaaaaatgggccacattaacacattaaaattcaaccagtaa

SEQ ID NO: 13895 - protein, 361 aa, Ehrlichia chaffeensis str. Arkansas
MLHDSYIGPGSTIGIIGGGQLGKMISIAAANLGYKTHLLTNNPDDPSVYITNSATISHNYQNTESLLEFASNVDIATLEFENIPTTTIDILSQKIKVYPGKEALYISQNRIREKQHIRNLGIKTSDFRVIDNYNSLVKNTIELGYPTLLKTTELGYDGKGQYIIKQQDDLSALSTLNWDQSYILEKFVKIYKEISVIITKSISGSIEFFPTAENCHTDGILTTSSVPALISQEINVQAQKIALQIAESINLVGLLAVEFFITDTQELIVNEIAPRPHNSGHWSLDACNISQFEQLIRAICGLPLKPVKLLFPCIMNNILGDNIHNYYKHETKVNENLYIYGKKKATKNRKMGHINTLKFNQ

SEQ ID NO: 13896 - DNA, 1161 bp, Francisella tularensis subsp. holarctica
  CDS (1)..(1161): transl_table=11
atgaatatttctaatatcaaaattatgttgcttggttcaggtgaactaggcaaagaattcataatagctgctcaaagacttggtatacacactatagctgtagatcgatataaaaatgcaccagctatgcaagtagctcacgaaagctatgttatagatatgctaaattcagatgctcttgagcaactaattctagcaaaaaatccaacgtatatagttcctgaaattgaagctataaataccgatagcttagtaaaactagaagctcataacttcaatattatcccatgtgcaaaagccacgaaactaactatggatcgccagggtataagagctttagctgtacaacagcttaatttacaaacatcaaaatttgcatttgcaaatagcgagcaggaatatctagatgtaatacaatcgattggtctaccatttgtgattaagcctgtaatgagctcttcaggtaaaggtcaatcaattgttaaagaacataatgaaattaaaaaagcttgggattatgctcaaaatggctctcgaggccatgctaaaggtgtaattgtagaacaatttatagattttgactatgagataacgctactaactgttagacataaagatggtacttcattttgcgaccctattggacatatccaaaaagatggtgattatcgcttctcttggcaacctcatacaatgccagatacggctttagcaaagtcacaagaaattgctaaagaaatcaccgatgcattaggtggctatggagtttttggagttgagttattcataaaaggtgatgaggtattttttaatgaagtctcacctcgtcctcatgacacggggatggtgacacttatatctcaaaatataaacgaatttgagctacatcttcgtgcaatagttggactacctatacctgatatacagacattacagccatctgcttctgcagcaatattacttgaaggagatactgctaacgcaagtatttgcggtattgataaagcattagctgatgcaaatgtagatataagaatatttagcaaaaaagaaatacatggtaaacgccgtatgggagttgtcttagcaaaagcacaaaatactcacatagctttagaaacttctaagcaagctctagcacatattcatcttactaaataa

SEQ ID NO: 13897 - protein, 386 aa, Francisella tularensis subsp. holarctica
MNISNIKIMLLGSGELGKEFIIAAQRLGIHTIAVDRYKNAPAMQVAHESYVIDMLNSDALEQLILAKNPTYIVPEIEAINTDSLVKLEAHNFNIIPCAKATKLTMDRQGIRALAVQQLNLQTSKFAFANSEQEYLDVIQSIGLPFVIKPVMSSSGKGQSIVKEHNEIKKAWDYAQNGSRGHAKGVIVEQFIDFDYEITLLTVRHKDGTSFCDPIGHIQKDGDYRFSWQPHTMPDTALAKSQEIAKEITDALGGYGVFGVELFIKGDEVFFNEVSPRPHDTGMVTLISQNINEFELHLRAIVGLPIPDIQTLQPSASAAILLEGDTANASICGIDKALADANVDIRIFSKKEIHGKRRMGVVLAKAQNTHIALETSKQALAHIHLTK

SEQ ID NO: 13898 - DNA, 1098 bp, Francisella tularensis subsp. holarctica
  CDS (1)..(1098): transl_table=11
atgaaaataggtattatcggagctggacaacttgccaggatgctaagcttagcaggtacacctttaggtttagagtttcattgtcttggtaaaaatggtgattgtgctgaagaagttgtaaaaactgttacagatattgagctaacaaaggtaaatgatgttgtagcttgggcaaagcagtttgatgttataacttttgaaaatgaaaatatctctcatgagcttatcaaagctataaatcatgaggtgagtgtgtatccatcagctaaagctatagctatttctcaagatcgtttacttgagaaatcttttatgcaagatcatggtattgctactgcaaaatttgtaaatatcgatagtttggcaaaattgcaaagtgctgttgatgatcatggtctgccagctatactaaaaactcgtcgatttggctatgatggtaagggccagtttgtgattagatcacaagaggatattactaaagcatgggatgtgctcaaggatgctccggatgggcttatttatgaggcttttgttgattttgattatgaagtttcacaaatatgtacagctgatctaaagggtaatatcgccttttatccattggctagaaatactcataagcagggtattattgttgaatcagaagcaccttttgaaaatgttgtacttgctgaaaaagcacaacaaatcgctaaaattctagtcaaggagtttgcatatgttggtactttggcaattgagttttttgtcaagggtgatgagctaatagtcaatgaaatagcgccacgtgtgcataatagcggtcattggagtattgatggcgccgtcacatcacaatttgaaaatcatgtgcgtgctattgccggattgattttaggtgatacaactagtcgtaagacagttatgctaaattgtatcggtggtatgccggcaacaaaagatttagcagctctagatagagttaaaattcatagttataacaaggagcctcgtaagggacgtaaagtaggtcatttaaaccttaatttaaatgatgaaactgatgagtatcagctacttcaagctaaaaaattaattgctctttctgaagaaatttag

SEQ ID NO: 13899 - protein, 365 aa, Francisella tularensis subsp. holarctica
MKIGIIGAGQLARMLSLAGTPLGLEFHCLGKNGDCAEEVVKTVTDIELTKVNDVVAWAKQFDVITFENENISHELIKAINHEVSVYPSAKAIAISQDRLLEKSFMQDHGIATAKFVNIDSLAKLQSAVDDHGLPAILKTRRFGYDGKGQFVIRSQEDITKAWDVLKDAPDGLIYEAFVDFDYEVSQICTADLKGNIAFYPLARNTHKQGIIVESEAPFENVVLAEKAQQIAKILVKEFAYVGTLAIEFFVKGDELIVNEIAPRVHNSGHWSIDGAVTSQFENHVRAIAGLILGDTTSRKTVMLNCIGGMPATKDLAALDRVKIHSYNKEPRKGRKVGHLNLNLNDETDEYQLLQAKKLIALSEEI

SEQ ID NO: 13900 - DNA, 1104 bp, Saccharophagus degradans 2-40
  CDS (1)..(1104): transl_table=11
atgagagtaggtattcttggtggtgggcagcttgctcaaatgatcgcacaagctggtgcaaaccttgatatgtcgtttaagtttatcagccccgacccaaaagcgtgcgcggcgccttatggcgagcatatctgtgcagattatcaagatgagcaagcgtatcaacaaatgcttgagtgggccgacgttttcacctatgagtttgaaagtattcccaaatctgttgtggaatcactagaaaagaagctcgccctgttgccatcatcaaaagcgttaaacgttgcgggagataggcttaaagaaaaacgcacctttaacggccttggtatacctacagcaaatttcgctcccgtagatagcctagaaagtttgcaaagcgccgtagagcagattgggctgcccgccatacttaaaactcgcagcgaaggctacgacggtaaagggcaagcggtgcttcgcgatgttagccagctagaagccgcttggcagagtgtagggcaagtgccttgcatcttagagtctatggttaactttagccgagaagtctctattattgccgcgagatctaagcagggtgagattgtgtattacccgcttacagagaatcatcatcgcgaggggattttgcgcttatcacttcccctgcagaacgacccttatcagcagcaagcagaaaagcttgcaaaagccttgctcgatgagctggattacgttggcgtgattgctgtagagctgtttcaggttggtgaaagcttggtagccaatgagttcgcgccacgcgtgcataactctggtcactggactattgagggtgcgcatacttctcagtttgaaaaccatttgcgagctatttgcggtttgcctttgggtaaaacagacgcgataaactcctgcgccatggtgaatattattggcaaattgcctcgcgaagaagatgttgccgccatagaaggggctcgctttcacgattacagcaaagatgaaaagcccggaagaaaaataggccacattaccattactagcgaaggtttaagtggcgaagcattcaatgcaaacttaaagtgtattttacagcttgtaggcgaagacccagagctacgctaa

SEQ ID NO: 13901 - protein, 367 aa, Saccharophagus degradans 2-40
MRVGILGGGQLAQMIAQAGANLDMSFKFISPDPKACAAPYGEHICADYQDEQAYQQMLEWADVFTYEFESIPKSVVESLEKKLALLPSSKALNVAGDRLKEKRTFNGLGIPTANFAPVDSLESLQSAVEQIGLPAILKTRSEGYDGKGQAVLRDVSQLEAAWQSVGQVPCILESMVNFSREVSIIAARSKQGEIVYYPLTENHHREGILRLSLPLQNDPYQQQAEKLAKALLDELDYVGVIAVELFQVGESLVANEFAPRVHNSGHWTIEGAHTSQFENHLRAICGLPLGKTDAINSCAMVNIIGKLPREEDVAAIEGARFHDYSKDEKPGRKIGHITITSEGLSGEAFNANLKCILQLVGEDPELR

SEQ ID NO: 13902 - DNA, 1143 bp, Methylobacillus flagellatus KT
  CDS (1)..(1143): transl_table=11
gtgagtagtgtaaaaactatattgcctccggccatgctggggatgttgggtggcggccagttgggccgcttctttgtgattgcggctcatgagatgggctacaaggtggcagtgctggatcctgaccgcaacagcccggcgggcaaaattgccgacgtgcatctctgtgctgcctatgatgatgagactgcgctgcagtcccttgccgagcaatgcgcggccattaccaccgaattcgagaacgtgcccgcatctacgctggaattcctggcgcagcatcgtactgtgcgtcctgccgctgcttcagtggctattgcgcagaatcgcgtcgcagaaaagaactttttccgcgactccggctttccggttgcgccgtatgccgtgattgagcaggctatcgatatccctgctgccgatagcggtttgtatcctgccatcctaaaggtggcgcgcttcgggtatgatggcaagggtcaggcgcgagtagcgactccggaggaggcaagcgccgcttttgagaagttcggtgccgaggtctgcgtgctggaacgcatgctcaggctggactacgaagtttccgtggtattggcacgggatgccgacggcaatgtggagaccttccctgcggcagaaaacagtcatttgaacggcattcttgatgtcagcatcgcgccggcacgaggtgatgcggctatccgggagcaggcacgccagctggctgtggatgttgcgcaaaagctgaattacacgggggttctgggcgtcgagtttttcgtcagccagggccgtctgctggtcaatgaaatggcaccgcgtccccataactccggacattacacgatagatgcatgcgtaaccagccagttcgagcagcaagtgcgtgtgttggcaggcctgccgctgggtgatgcgcgccagcacagtcccgcagtcatggtgaatctgctgggcgatatctggagcaggggtgagccttcatgggatgctgcctatgccgagccagggttgaaaatgcacctttatggcaagcatgaagccaggccaggccgaaagatggggcactttaccgtggttggagataaggcggaccagacgctgcaaggcgcgttgaaggttcgccacttgcttggcatcagggattga

SEQ ID NO: 13903 - protein, 380 aa, Methylobacillus flagellatus KT
MSSVKTILPPAMLGMLGGGQLGRFFVIAAHEMGYKVAVLDPDRNSPAGKIADVHLCAAYDDETALQSLAEQCAAITTEFENVPASTLEFLAQHRTVRPAAASVAIAQNRVAEKNFFRDSGFPVAPYAVIEQAIDIPAADSGLYPAILKVARFGYDGKGQARVATPEEASAAFEKFGAEVCVLERMLRLDYEVSVVLARDADGNVETFPAAENSHLNGILDVSIAPARGDAAIREQARQLAVDVAQKLNYTGVLGVEFFVSQGRLLVNEMAPRPHNSGHYTIDACVTSQFEQQVRVLAGLPLGDARQHSPAVMVNLLGDIWSRGEPSWDAAYAEPGLKMHLYGKHEARPGRKMGHFTVVGDKADQTLQGALKVRHLLGIRD

SEQ ID NO: 13904 - DNA, 1197 bp, Burkholderia xenovorans LB400
  CDS (1)..(1197): transl_table=11
atgaacccagacaacaacccggtttcaccgattctgcccggcgcatggcttggcatggtcggtggcggccagctcggccgcatgttctgctttgccgctcaggctatgggctatcgcgtcgccgtgctcgatcccgacgaaaacagtccggcgggcgccgttgccgatcggcatctgcgcgcggcgtacaacgacgaagcgtcgctcaccgagctcgcgcggctgtgcgcggcggtgtccacggagttcgagaacgtgcctgccgcgagcctcgacttcctcgcgcggaccaccttcgtgagtccggctggccgctgcgtcgccgtggcgcaggaccgcattgccgagaagcgcttcattgcgtcatcgggcgtgacggtcgcgccgcatgtggtgatcgaatcgtcggatgcgctcgccgcgctcgacgacgccaaactcgaagccgtgctgccgggcattctcaagaccgcccgcatgggctacgacggcaaaggccagattcgcgtgcgcaacgccgaggaagtgcgcgaggcgcatgcttcgctcgccggagtgccgtgcgtgctggaaaagcggttgccgctgaagttcgaagtgtccgcgctgattgcgcgggcagcgagcggcgcctcggtggtctatccgctcgcgcagaacacgcatcgcgacggcgtgctgtcgcacaccattgtcccggcgccggacgcgagcccgacgctcgttcagcaggcgcagcaggccgcgctgcaaatcgccgacaaactcggttacgtgggcgtgctgtgcgtcgagtttttcattcttgaagacggctcgctggtcgccaatgaaatggcgccgcgtccgcacaactccggccattacacggtcgacgcctgcgcgaccagccagttcgagcagcaggtgcgcgccatgaccggcatgccgttgggcgatacacgtcagcattcgccggcggtgatgctcaacattctcggcgacgtgtggtttccggacggcccgaagcgcccggcggtcacgccgccctggcaggaggtcgccgcgatgccggcggcgcgtttgcatctgtacggcaaggaagaggcgcgttgcggccgcaagatgggccacgtgaacttcacggcggctacgctcgaagaagcccgcaccgctgcgcgcgattgcgcacggcttctgcacatcatcacgagctga

SEQ ID NO: 13905 - protein, 398 aa, Burkholderia xenovorans LB400
MNPDNNPVSPILPGAWLGMVGGGQLGRMFCFAAQAMGYRVAVLDPDENSPAGAVADRHLRAAYNDEASLTELARLCAAVSTEFENVPAASLDFLARTTFVSPAGRCVAVAQDRIAEKRFIASSGVTVAPHVVIESSDALAALDDAKLEAVLPGILKTARMGYDGKGQIRVRNAEEVREAHASLAGVPCVLEKRLPLKFEVSALIARAASGASVVYPLAQNTHRDGVLSHTIVPAPDASPTLVQQAQQAALQIADKLGYVGVLCVEFFILEDGSLVANEMAPRPHNSGHYTVDACATSQFEQQVRAMTGMPLGDTRQHSPAVMLNILGDVWFPDGPKRPAVTPPWQEVAAMPAARLHLYGKEEARCGRKMGHVNFTAATLEEARTAARDCARLLHIITS

SEQ ID NO: 13906 - DNA, 1245 bp, Ralstonia metallidurans CH34
  CDS (1)..(1245): transl_table=11
atgccgaccgatatccatccccacctgtccgaagcgcatacccccgagtcgcgcgccgagttcggcgtgaacagtccgaactcgccgatcctgccgggcgcctggctcggcatgctcggcggcggccagctcggccgcatgttcacgcacgcggcgcagtcgatggggtaccgcgtttgcgtgctcgatccggaccaggacagcccggccggctccgtggctgaccggcacatctgcgcggcatacaccgacgatgcggcgctggccgaactgtccagcctgtgcgaggcggtgagcaccgagttcgagaacgtgccgtcgatctcgctcgagcgtctggaggaagccggcgtgttcgtcgcgccgcgcggctactgcgtgtcgatcgcgcagaaccgcatcggcgaaaagaagttcttcgcctcctgtgcggaccgtaccggcgtgccgccggccccgcactgggtgatccagcacgatgccgatgtggaccggctgcctgacgaagtgctgccgggcatcctgaaaaccgcgcggatgggctacgacggcaagggccaggcgcgcgtgaagtcgcgcgacgacgtgcgcgccgcatggaaggccatgcagcatgtaccgtgcgtgctcgagcggatgctgccgctggcgtacgaggtgtcggtgctggccgcgcgtgccgccgatggctccaccgccacgtggccgctggccgagaacgtgcaccgcgatggcatcctgttttcgacgacgatgccttcgacgagcgtgtcggacgatatttcccaacgcgcccgcaacgccgcggcgacgattgcttcggaaatgggctacgtcggcgtgctttgcatcgaattcttcgtgctgaccgatggcacgctggtggccaatgaaatggcgccgcgcccgcataactcggggcacatcacgatggatgcctgcgagaccagccagttcgagcaacaggtccgcgcgatggctcgcctgccgctgggcagcacccgccagcattcggccggcaagatgctgaacctgcttggcgactgctggttcgagttcggcctggagcgtacgcccgcgtgggatgaggtgctggcgcagcccggcgccaagctgcacctctacggcaagaacgatgcgcgcccgtcgcgcaagatggggcacgtgaactgcgttggcgaccacgccgaagcggccgaccgcacgttcgatgccgccgccaaggcgctgcacatccccagctga

SEQ ID NO: 13907 - protein, 414 aa, Ralstonia metallidurans CH34
MPTDIHPHLSEAHTPESRAEFGVNSPNSPILPGAWLGMLGGGQLGRMFTHAAQSMGYRVCVLDPDQDSPAGSVADRHICAAYTDDAALAELSSLCEAVSTEFENVPSISLERLEEAGVFVAPRGYCVSIAQNRIGEKKFFASCADRTGVPPAPHWVIQHDADVDRLPDEVLPGILKTARMGYDGKGQARVKSRDDVRAAWKAMQHVPCVLERMLPLAYEVSVLAARAADGSTATWPLAENVHRDGILFSTTMPSTSVSDDISQRARNAAATIASEMGYVGVLCIEFFVLTDGTLVANEMAPRPHNSGHITMDACETSQFEQQVRAMARLPLGSTRQHSAGKMLNLLGDCWFEFGLERTPAWDEVLAQPGAKLHLYGKNDARPSRKMGHVNCVGDHAEAADRTFDAAAKALHIPS

SEQ ID NO: 13908 - DNA, 1098 bp, Silicibacter sp. TM1040
  CDS (1)..(1098): transl_table=11
atgactgatctcgaccaaatcctcgaacccggtgccgtaatcggcattctgggcggtggtcagcttggccggatgctgtcggttgcagcctcccgccttggcttcaccacccacatctacgagccggccgcgaatccgcctgcgggccatgttgcggatcgggtcacaaccgctgcctatgaggatgaggcggccttgcgcgcctttgcacaaaccgtggatgtgatcacctatgagtttgaaaatatccccacctcagcgctcgacattctcgaggatctgaaaccgatccgccccggtcgcgaggcgcttcgggtgtcgcaggaccgcctgacggaaaagacctttctgcaagagcttgggctggcaacagcgccctttgcagaggtggatgatgccgccagccttgaagttgcattggaaaaggtcggcacgccttcgatcctgaaaacgcggcgttttggctatgatggcaagggtcagatgcgcatcatgcatcccgaagaagctccggaggccttggccgccatgcaaggagcgcccgcggtgctcgaagggtttgtccccttcagccacgaggtctcggtcatcgcagcccgcagcctcaatggcaaagtcgcctgctatgatccgggcgagaacgtgcatctcgaaggcatcctcagcaccaccaccgtgcccgcaaacctcacgacgggtcagagcatggatgcggtgctgatggccggtaagatcctgaacgccctcgattacgttggtgttctggcggtcgagatctttgtcaccgcgcatggcctagtggtcaatgaaatcgccccgcgcgtgcacaactcgggtcactggacgcaggaaggctgcaccatcgaccagttcgaacagcacatccgggccatcacaggctggaccatcggcaatggcgcccgttacgccgatgttgtgatggaaaacctgattggcgaggacgtgggacgtatcgccgatcttgcacgcgatcccgattgcgccattcatctctatggcaaggccgaaacaaagcctggccgcaagatgggccatgtaaaccgtgtcatccacaccgaagggcgcgagggctactga

SEQ ID NO: 13909 - protein, 365 aa, Silicibacter sp. TM1040
MTDLDQILEPGAVIGILGGGQLGRMLSVAASRLGFTTHIYEPAANPPAGHVADRVTTAAYEDEAALRAFAQTVDVITYEFENIPTSALDILEDLKPIRPGREALRVSQDRLTEKTFLQELGLATAPFAEVDDAASLEVALEKVGTPSILKTRRFGYDGKGQMRIMHPEEAPEALAAMQGAPAVLEGFVPFSHEVSVIAARSLNGKVACYDPGENVHLEGILSTTTVPANLTTGQSMDAVLMAGKILNALDYVGVLAVEIFVTAHGLVVNEIAPRVHNSGHWTQEGCTIDQFEQHIRAITGWTIGNGARYADVVMENLIGEDVGRIADLARDPDCAIHLYGKAETKPGRKMGHVNRVIHTEGREGY

SEQ ID NO: 13910 - DNA, 1143 bp, Myxococcus xanthus DK 1622
  CDS (1)..(1143): transl_table=11
atgagcccccgcgtggtgctgcccggcggcacgattggcatgctcggcggtggccagctggggcggatgatggccctggccgcgcgcacgctcggcttccaggttcaggcgttggacccggacgcggactgcccggcccactccgtggtggacctgtgtgttaccgcgtccttcggtgacacggcggccgcggagacgctggcgcgcgcgtgcgacaccgtgacgctcgaaatcgagaagattcccctccccacgctggaagcggtggcgcggcacacccccatgcgcccgggtgcggacgtgctccgcgtgattcagcaccggggccggcagaagggctggctcgccaaggggggctttcccctgggcccgtggcgcgaggcgcactccgccgcggagctggccgaagccatccaggcgctgggtggacgctgcttcgtgaagtccagtgagggcggctacgacgggcgcgggcaggtggaggtgacctccgcggacgaggccgcccaggcgtggcgcgagctgggtgagcgctccgtggtggtggaggccgcgctggcgctccagtccgagctgtccgtgctggtggcccgcagccccaatggagaagtggcggtgtatccgccagccttcaatcaccacgaggagcgcatcctcgcgtggtcgctgctgccggggccgctgccgcccgcggtgctggacacggccacggagctggcgcgcggcatcaccgagtcgctccaggtcgaaggcctgctcgtcatcgagctgttcctgctgaaggacggcagcgtgctcgtcaacgagctggcgccgcgcccgcacaacagcttccactccaccgaggtggcgtgcctcacctcccagttcgagcaggcggtgcgcgcggtgtgcaacctgccgctgggctccgtggaggtggtgcgtccagcggccatcgtcaacctgctgggcgacttgtggctgaaggacggcggccctcgcttccaggaggtgctggccatgcccggcgtccgcctgcacctgtacggcaagcgggaggcgcgcaagggccggaagatggggcacctgtccgcggtgggcagctcgcccgaggacgcgctcgctcgcgtgcaggccgccgccaccgcgctggggatgtga

SEQ ID NO: 13911 - protein, 380 aa, Myxococcus xanthus DK 1622
MSPRVVLPGGTIGMLGGGQLGRMMALAARTLGFQVQALDPDADCPAHSVVDLCVTASFGDTAAAETLARACDTVTLEIEKIPLPTLEAVARHTPMRPGADVLRVIQHRGRQKGWLAKGGFPLGPWREAHSAAELAEAIQALGGRCFVKSSEGGYDGRGQVEVTSADEAAQAWRELGERSVVVEAALALQSELSVLVARSPNGEVAVYPPAFNHHEERILAWSLLPGPLPPAVLDTATELARGITESLQVEGLLVIELFLLKDGSVLVNELAPRPHNSFHSTEVACLTSQFEQAVRAVCNLPLGSVEVVRPAAIVNLLGDLWLKDGGPRFQEVLAMPGVRLHLYGKREARKGRKMGHLSAVGSSPEDALARVQAAATALGM

SEQ ID NO: 13912 - DNA, 1191 bp, Mycobacterium sp. MCS
  CDS (1)..(1191): transl_table=11
gtggtggccatgatcggcgggggtcaactcgcccggatgacccaccaggcggcgatcgcgctgggccagactctgcgggtgctcgccaccggcccgcaggagccggccgcccaggtgacccccgacgtggtgatcggatcgcataccgacctcgacgcgctccggcgcgcggccgccggtgcgaccgtactgaccttcgaccacgaacacgtccccaccgaagcactcgagacgctggtggccgagggggtcaacgtggcgccgccgccggccgcgctggtgcacgcgcaggacaagctggtgatgcgcaggcgactcgaagcgatgggtgcgccgatcccgcgctacaccgccgtcgacaccgtcgacgacgtcgtggccttctcgtccgaggtcgatggcccggtcgtgctcaagacggtccgcgggggatacgacggccgcggcgtggtgctgaccgccgacgccgaggaggcgcgcgacgtggccgcccgctacctcgccgacggtgtgccgatcctggccgaggagcgtgtcgacatgcgccgcgagctcgcggccctggtggcccggtcaccgttcgggcagggtgcggcgtggccggtggtcgagaccgtgcagcgcgacggcatctgcgtcgtggtgctggccccggcgccggagttgtccgacgacctgggctcgagcgcccagcagctggggttgaagctggccgccgaactcggcgtggtcggggtgctcgccgtcgaactcttcgaaacggtcgacggccggctgctggtcaacgaattggcgatgcggccgcacaactccgggcactggagcatggacggcgcggtcaccggccagttcgaacagcacgtccgcgcggtgctggactatccgctcggcgacacctcgctgctcgccccggccaccgtgatggccaatgtcctcggggcgccgcagactccggcgatgacgatggacgaacgggtgcaccacctgttcgcccgcatgccggacgccaaggtgcacctgtacggcaagggggagcggcccggccgcaagatcggccacgtcaacctcaccggtgacgatccggcggtgttgcgtgagcgggccgagcgggccgcgcactggttgtcccacgccgagtggaccgacggatgggatccgcacgccgaagtcagggaaggaatctcgaggtga

SEQ ID NO: 13913 - protein, 396 aa, Mycobacterium sp. MCS
MVAMIGGGQLARMTHQAAIALGQTLRVLATGPQEPAAQVTPDVVIGSHTDLDALRRAAAGATVLTFDHEHVPTEALETLVAEGVNVAPPPAALVHAQDKLVMRRRLEAMGAPIPRYTAVDTVDDVVAFSSEVDGPVVLKTVRGGYDGRGVVLTADAEEARDVAARYLADGVPILAEERVDMRRELAALVARSPFGQGAAWPVVETVQRDGICVVVLAPAPELSDDLGSSAQQLGLKLAAELGVVGVLAVELFETVDGRLLVNELAMRPHNSGHWSMDGAVTGQFEQHVRAVLDYPLGDTSLLAPATVMANVLGAPQTPAMTMDERVHHLFARMPDAKVHLYGKGERPGRKIGHVNLTGDDPAVLRERAERAAHWLSHAEWTDGWDPHAEVREGISR

SEQ ID NO: 13914 - DNA, 1167 bp, Rubrobacter xylanophilus DSM 9941
  CDS (1)..(1167): transl_table=11
gtgagccggaccatcctccccgggagcacggtcggcgtgctgggcggcggccagctcggtcgcatgctggcgcttgcgggcggccacatgggctaccggttcgtggtgctcgacccgacgcccaacgcccccgccgggcaggtctcgagcggccaggtcgtggccgcctacgacgaccgcgaggccgccggcaggctcgccgcctcctccgacgtgatcacctacgagttcgagaacgtggacgccggggtggccgggatgctggagcgggaggcgtacgtcccccaggggagccggctgctgcacaccacccagcaccggctgcgcgagaagcgggccgtggaggaggcgggggtgcgggtcgccccctacgagccggtgcgagacggcgaggacctgcgggccgcgctgcggcgcctcggcaccccctgcgtgctcaagaccgccacgggcggctacgacggcaggggccagcgcgtcatccgctccgaagacgaggccccggcggccctctcggagctctccggggaggggaccgagctggtgctggagcgctttgtccgcttcgagaaggagctctcggtcatcgccgcccgcacccccgggggggaggtccggaccttcccccccgccgagaacgtccacgtggacaacatcctccacctctccatcgtccccgcccgcatcccgcgggaggtgcaggaggaggcccggcggatggcggtgcgcgtggccgaggggctcggcgtggtggggctcgtcgccgtggagatgttctgggccggcggcgacgggctctacgtcaacgagctcgccccccgcccccacaactccggccactacaccatagaggcctgcgccacctcccagttcgagcagcacctcagggccatatgcaacctgccgctcgggccgaccgacctcctcacccccgccgtgatggtgaacgtgctgggcgagcatctggagccgctcgtccgcgcgctctcggaggggaggatcgccgcccgcggcggggcggtgccgaaggtccacctctacggcaaggccgagtcgcgccccaagcggaagatgggccacgtgaccctcctcgccccggagacgggcgccgccctccggtgggtcgaggagagcggcctctggaaggcgcagggaggggccgcctag

SEQ ID NO: 13915 - protein, 388 aa, Rubrobacter xylanophilus DSM 9941
MSRTILPGSTVGVLGGGQLGRMLALAGGHMGYRFVVLDPTPNAPAGQVSSGQVVAAYDDREAAGRLAASSDVITYEFENVDAGVAGMLEREAYVPQGSRLLHTTQHRLREKRAVEEAGVRVAPYEPVRDGEDLRAALRRLGTPCVLKTATGGYDGRGQRVIRSEDEAPAALSELSGEGTELVLERFVRFEKELSVIAARTPGGEVRTFPPAENVHVDNILHLSIVPARIPREVQEEARRMAVRVAEGLGVVGLVAVEMFWAGGDGLYVNELAPRPHNSGHYTIEACATSQFEQHLRAICNLPLGPTDLLTPAVMVNVLGEHLEPLVRALSEGRIAARGGAVPKVHLYGKAESRPKRKMGHVTLLAPETGAALRWVEESGLWKAQGGAA

SEQ ID NO: 13916 - DNA, 1095 bp, Mesorhizobium sp. BNC1
  CDS (1)..(1095): transl_table=11
atgagccagccgcttgcgcctggtgccacgatcggcatcgtcggcggcggccaactcgggcgaatgctcgccatggctgccgcgcgccttggctacttcacggtcgttctggagccggacgaggaatgcccggcaggagatgtggcgagccatctcatcgtcgctgcctatgacgacggcagggctttggagcaacttgccaagttcagtgatgtggtaacatacgaattcgagaacgtgcccgtgatggcggcacgctcccttgccgaccgcgttccgctctatccctcggccgaagcgcttgaaaccgcacaagatcgcttggcggaaaagattttccttaacaccgtcggtattccgaccgccccgttcatttccgtcaacacagacgaggaaatggctcaggggctcgcccgcttcaatggcaatggcgtgctcaagaccagacgtctgggttatgatggcaaaggccagcgcgtcttcaggggagccgggccaggcgatgccgaaggagtggtggccgccatgggcggcgtgccgctcattcttgaagggctgatatcattcgaacgggagatctccataatcgccgcgcgtgcgttggatggtgccttggccgcttacgacccatcggaaaacctgcaccgcaacggaattctgcatcaatcgaaagttccagccgctatttccaacgaaaccgcggaaacggccagagaagccgcctacgccattctctccgcgctcgattatgtaggtgtcatcggggtcgaattcttcgtgcttggcgatgggtcgctcctcgtgaacgagatggcgccgcgggttcataattccggccactggacggaggcagcttgcactatctcccagttcgaacagcacatccgggccattgccggattgccgctgggcagcacgacacgtcattccgattgcataatggaaaatctgatcggtgcggagcaagagcgggcgccagccttgctcactgagcccaacctcctgcttcacctctatggaaaagctgaggcgaggcccggtcgcaagatggggcatttcacgcggatcctgccccgcaagaacagcacgagctga

SEQ ID NO: 13917 - protein, 364 aa, Mesorhizobium sp. BNC1
MSQPLAPGATIGIVGGGQLGRMLAMAAARLGYFTVVLEPDEECPAGDVASHLIVAAYDDGRALEQLAKFSDVVTYEFENVPVMAARSLADRVPLYPSAEALETAQDRLAEKIFLNTVGIPTAPFISVNTDEEMAQGLARFNGNGVLKTRRLGYDGKGQRVFRGAGPGDAEGVVAAMGGVPLILEGLISFEREISIIAARALDGALAAYDPSENLHRNGILHQSKVPAAISNETAETAREAAYAILSALDYVGVIGVEFFVLGDGSLLVNEMAPRVHNSGHWTEAACTISQFEQHIRAIAGLPLGSTTRHSDCIMENLIGAEQERAPALLTEPNLLLHLYGKAEARPGRKMGHFTRILPRKNSTS

SEQ ID NO: 13918 - DNA, 1266 bp, Cytophaga hutchinsonii ATCC 33406
  CDS (1)..(1266): transl_table=11
ttgctggcgcaaaacagcaatcaacccctttttatgaaatcatacatttttacacactttacacgccaaactttacactttacactttttacttccgtatctttggagttattgttatttataaaaatggaacatttctattcagactacaaaattggcatgctgggcggcgggcaactggggcgtatgttgctgcaggcggctgttgattataacttagaaattcatgtactcgacccggacagcgatgcaccatgcaaaaactggggcacaagctttactacaggttctttgacggattttgatacggtatatcagttcggcaaagagatggatctgattacgattgaaattgaaaatgtgaatgttgacgcactgaaaaaacttcaaaaagaaggtacaaaggtttatccgcaaccggagatcattgaaatgatacaggataaacgtcttcagaaagaattttatataaagaataatattccaaccgcaccatttgtacgtacagaaacaaaggaagatattttaaaacacctggatctgttaccggctgtacacaaactgggtaaagaaggctacgatggcaaaggcgttcagttgatcaatacaaaaaatgatatagcaaaaggctttgacaaaccagggttactggaaaagaaaatagatttcgcaaaggaattaagcgttattgtagcgcgcaacaaagatgggcagatcagcgcgtttccaaccgttgagatggtatttcacccgacacataatctagtagagtttttattttcgccggcagaaatttcagaagaactgcataagaaagcagaaaaaattgccagaggcgtgatcaacgatatcgggctggttggtattttagccgttgaaatgtttttaacaacggaaggcgaaattcttgttaacgaaatcgctccacgtccgcataacagtggccatcaaaccatacaggcaaattatacgtctcagtacgaacagcatttacgtgctattttaaacatgcctttaggtgcaacaacccagcattgtccggcggcaatggtaaacctgttgggggaaccgggctatgtaggaagcgccatttttgaaggcctggaagaagcactgaatatagaaggcgtatacccgcatttatatggaaagaaaatcaccaaacctttccgaaagatggggcatgttactattttagataagtcaattgaaggcttgaaaaagaaatcggacgaagttaaaaatcttataaaaattattgcatga

SEQ ID NO: 13919 - protein, 421 aa, Cytophaga hutchinsonii ATCC 33406
MLAQNSNQPLFMKSYIFTHFTRQTLHFTLFTSVSLELLLFIKMEHFYSDYKIGMLGGGQLGRMLLQAAVDYNLEIHVLDPDSDAPCKNWGTSFTTGSLTDFDTVYQFGKEMDLITIEIENVNVDALKKLQKEGTKVYPQPEIIEMIQDKRLQKEFYIKNNIPTAPFVRTETKEDILKHLDLLPAVHKLGKEGYDGKGVQLINTKNDIAKGFDKPGLLEKKIDFAKELSVIVARNKDGQISAFPTVEMVFHPTHNLVEFLFSPAEISEELHKKAEKIARGVINDIGLVGILAVEMFLTTEGEILVNEIAPRPHNSGHQTIQANYTSQYEQHLRAILNMPLGATTQHCPAAMVNLLGEPGYVGSAIFEGLEEALNIEGVYPHLYGKKITKPFRKMGHVTILDKSIEGLKKKSDEVKNLIKIIA

SEQ ID NO: 13920 - DNA, 1260 bp, Rhodococcus sp. RHA1
  CDS (1)..(1260): transl_table=11
gtgaccggcaactctgactccacaccgcgtcccacgacaccccgcgatctgaccgccgggcaacccgtcgtgacgatgatcggtggcggccaactcgcgcggatgacccaccaggccgcgattgcgctcggccagaccctgcgggtgctctccggcaccgccgacgaacccgcagcccaggtgagccccgacgtcgtcctcggcagccacaccgacctcgacgcgctccgcagagccgcggtcgggtcgcacgcgttgaccttcgaccacgagcacgtgcccaccgagcacctcgacgtcctggtcgccgagggcgtcaacgtgcagccgccgccgacggcgctcatctacgcacaggacaagctggcgatgcgccgcaagctcgccgaactcggcgcacctgtcccggcctatgccgaggtgacctgggccgaggacgtcgtcaagttcggcgccgaacacggatggcctgtcgtgatcaaggccgtccgcggcggatacgacggtcgtggcgtgtggatcaccgacgattccgacgaagccgagcgcatcgtcacccagcaactcgaccagggtgtctccctcatcgtcgaggaaaaggtcgagatgcggcgtgagctgtccgcgatggtggcgcggtcaccgttcggtcagggcgccacgtggcccgtcgtggagacggtacaacgccacggacagtgcgccgtggtcctcgcccccgccccggcgctgcccgactcggtcgccgaggccgccgaggaactggcgctccgcatcgcttccgaactcggagtggtcggcgcgatggccgtcgaactgttcgaaaccaccgacggcacgctcgtcgtcaacgaactagcgatgcgcccgcacaactccggtcactggaccatggacggcgcccgcacctcacagttcgagcagcacctgcgcgccgtcctcgactacccgctcggcgacaccgcaccgctcgcaccgatcacggtgatggcgaacgtgctcggcgcaccgacggcccccgagatgagcatggacgaacgcgtccaccacctcttcgcccgaatgcccgacgcaaagatccacctgtacggcaagggggaacgtgaggaccggaagatcggccacgtgaacatcgtcggcggacccggctcgatcgacgaccccgagtacgtggcgcgggtgcgcgagcgcgccgagcgcgccgcgcactggctctcgcacgctgaatggaccgacggatgggatgtacacggtgagtga

SEQ ID NO: 13921 - protein, 419 aa, Rhodococcus sp. RHA1
MTGNSDSTPRPTTPRDLTAGQPVVTMIGGGQLARMTHQAAIALGQTLRVLSGTADEPAAQVSPDVVLGSHTDLDALRRAAVGSHALTFDHEHVPTEHLDVLVAEGVNVQPPPTALIYAQDKLAMRRKLAELGAPVPAYAEVTWAEDVVKFGAEHGWPVVIKAVRGGYDGRGVWITDDSDEAERIVTQQLDQGVSLIVEEKVEMRRELSAMVARSPFGQGATWPVVETVQRHGQCAVVLAPAPALPDSVAEAAEELALRIASELGVVGAMAVELFETTDGTLVVNELAMRPHNSGHWTMDGARTSQFEQHLRAVLDYPLGDTAPLAPITVMANVLGAPTAPEMSMDERVHHLFARMPDAKIHLYGKGEREDRKIGHVNIVGGPGSIDDPEYVARVRERAERAAHWLSHAEWTDGWDVHGE

SEQ ID NO: 13922 - DNA, 1089 bp, Haemophilus somnus 129PT
  CDS (1)..(1089): transl_table=11
atggtaaaccgcactttatatcctacagtgtatgttttaggtaatgggcaattgggcagaatgttgcgttatgcgggtgcacctttagatattaatgtccaacctcttgcttttgatgcacctgtttttgatttgcctgctgacagtattattacagcagaaattgaacgttgggaaaaaacaccccttacagaaatgttggctaatcacgataaatttattaatcaaaaaatttttgccactacagcagatcgttttacacaaaaaaccttgcttaacgcactaaatattcctacttccccttggaggttggtacaaagtgcggaggattttttcactatttttacagaaattggtgaaaaagttgttgtaaaacgtcgcatgggaggttacgacggacgaggacaatggattgtagataaaaacaatcaaggtgtaatcggcaatgagctttttggcgaagttattgccgaaaaatttattccttttgattatgaaatttctttggttggtgcaaggtttaaaaatggcaaaactcgtttttatcctgttacacataatctacaacagaatggtattttacgttacagtgtcatgaatttaaattttccacaacagtcacaacaacaaaaacaagccgaaataatgttggctaaaattatggataaattagattatgttggcgtaatggcaatggaatgttttgttgtgcaagatcaattattagtcaatgaattggcaccaagagtacataatagtggacattggacgcaattaggttgttcgattagccaatttgaattacatcttcgtgcgttattagatttacctacgcctgatttacaagtggctatgccgtcggttatggtgaatttaattggcactgaacataatccacaatggttaaatttgccattttcacaattacattggtatggaaaagaagtacgagaaggtcgtaaagttgggcatcttaatttatctcatccaactccgtctattttaatagataatttacaaaaattacgctacatactaccgcaagattatcaatttggtttagattgggcattggaaaaattgaaataa

SEQ ID NO: 13923 - protein, 362 aa, Haemophilus somnus 129PT
MVNRTLYPTVYVLGNGQLGRMLRYAGAPLDINVQPLAFDAPVFDLPADSIITAEIERWEKTPLTEMLANHDKFINQKIFATTADRFTQKTLLNALNIPTSPWRLVQSAEDFFTIFTEIGEKVVVKRRMGGYDGRGQWIVDKNNQGVIGNELFGEVIAEKFIPFDYEISLVGARFKNGKTRFYPVTHNLQQNGILRYSVMNLNFPQQSQQQKQAEIMLAKIMDKLDYVGVMAMECFVVQDQLLVNELAPRVHNSGHWTQLGCSISQFELHLRALLDLPTPDLQVAMPSVMVNLIGTEHNPQWLNLPFSQLHWYGKEVREGRKVGHLNLSHPTPSILIDNLQKLRYILPQDYQFGLDWALEKLK

SEQ ID NO: 13924 - DNA, 1161 bp, Trichodesmium erythraeum IMS101
  CDS (1)..(1161): transl_table=11
atggtaaaaatgaaaatgaatgaagaggaaaaaaaacaacaaaacaaaattcagcgagtgggtgttgttggtggtggtcaattagcatggatgatgggggatgcagcaaaaaaactaggagtagatttaattattcaaactcctcatcaagatgacccagcagtatctattgcaaaggatataattttggcagaaattgatgaccctcaggcaactactaagttagcaaatatttgtgatgtgattacctttgagaatgagtttattaatatagatgagttatcatatcttgctgaaaagaatgtaatttttcgtcctagtttatctgtgttgaagccgttattagataaatatgaacagttatgttatttacgatatttgggtttacctgtaccgaacttttgggagtggggaatagagattgagcctttatctttccctttggtattgaaagctcgtcgtcatggttatgacggtcagggtacttttattattaagaatattgagagtttaaaatctcagggaaattcagaatttttcatacaagaatttattccttttgaacgagaggttgctgttattgctgctcgtggagttactggggaagttaaggtttatcctgtggtagaaactcaacaagaaaaccaggtttgccagcgggtttttgtacctgatgaaaatttagaattagtaacagaaattgaagagatcgctcagactctccttaatagtttagaagtagtaggagtatttgggatagaaatgtttattactaaagacaagaaggttttaattaatgaaattgctccaagaactcataactctggtcattacagtttggatgcttgtgaagtttcccagtttgaacaacatttacgggctgtttgtggtttacctttaggtaatactactctcaaagtaaggagagcggtgatggtaaatttattgggttatgaatttggggaaaattactacttgacaaaacggcaaatgttagaaaaaattcctcatgcttcggtttggtggtatggcaaaacagaatctcgcccaggacggaagttaggtcatgtgactgttttgctagatgaggaaaattttgaaattatgggtcgcaagggtgaggcgatcgctaataaaatagagaatatctggtacacctaa

SEQ ID NO: 13925 - protein, 386 aa, Trichodesmium erythraeum IMS101
MVKMKMNEEEKKQQNKIQRVGVVGGGQLAWMMGDAAKKLGVDLIIQTPHQDDPAVSIAKDIILAEIDDPQATTKLANICDVITFENEFINIDELSYLAEKNVIFRPSLSVLKPLLDKYEQLCYLRYLGLPVPNFWEWGIEIEPLSFPLVLKARRHGYDGQGTFIIKNIESLKSQGNSEFFIQEFIPFEREVAVIAARGVTGEVKVYPVVETQQENQVCQRVFVPDENLELVTEIEEIAQTLLNSLEVVGVFGIEMFITKDKKVLINEIAPRTHNSGHYSLDACEVSQFEQHLRAVCGLPLGNTTLKVRRAVMVNLLGYEFGENYYLTKRQMLEKIPHASVWWYGKTESRPGRKLGHVTVLLDEENFEIMGRKGEAIANKIENIWYT

SEQ ID NO: 13926 - DNA, 1170 bp, Synechococcus sp. CC9311
  CDS (1)..(1170): transl_table=11
atgcccagcgttgacaacacaattggtgtaatcggtggcgggcaacttgccctgatgctcggtgaagcagcgcaaacacgaggtttgacgcttgcggttcaagcgtcaaaagctgaagaccctgctgcctccctggcgaaggatctagtgatcgctggatccacagatgcccgtgcaacgagggagctttcaacgtactgcgccggcattaccttcgaaaatgaatgggttgctgttgatgcattgatgcctcttgagcgacagggagtgcaattcactccatcactagccagcttggttcctctcgttaataagttgtcccagcgacggcttctcgacgatctgttaatcccaagtccagaatggatttcattagctgagctcaatcctggatcgccatccttaccgagcggatggacttttcctgtcatggcgaaggctgcctatggcggttatgacggcaaaggcacacgagttgtaaaagatctgaacggcttggctcagttgcttcgcaacgtcgatgccaatgagtggttaatcgaagcctgggtttcctacgagcaggaacttgctctcgttgtcagccgagattcaaaagggcgaatccgaagccttcccttagctgaaacgcatcagaaaaaccaagtttgtgactgggtgattgcgccggcagcagtgagtcaactcgtcgaggcaacggcttacaacattgcagcttcacttcttacaaagcttagttatgtgggggtgatgactttggagtttttctatggatcgtcaggtttatttgtcaatgaagtagcgcctagaacacataattcagggcatttttcaattgaggcttgttcaagtagtcaatttgatcaacaactctgtattgcggcaggtctggatgtacccaatccagatctgattgcagatggctccttgatggtcaatctgcttggtctaagtcaagaccatgcagaaccgcttgaagaacgtcttgccaaactccgctcgatgaaggagttgcatttgcattggtacggaaaagatgaaatcccgggacgcaaattggggcatgtcaccaccctgctcaagggccatagcgctgctgaacgggccgagattggacagcaaatgctgcaaagcattcgtgaaatctggcctcttcccctaaattggtag

SEQ ID NO: 13927 - protein, 389 aa, Synechococcus sp. CC9311
MPSVDNTIGVIGGGQLALMLGEAAQTRGLTLAVQASKAEDPAASLAKDLVIAGSTDARATRELSTYCAGITFENEWVAVDALMPLERQGVQFTPSLASLVPLVNKLSQRRLLDDLLIPSPEWISLAELNPGSPSLPSGWTFPVMAKAAYGGYDGKGTRVVKDLNGLAQLLRNVDANEWLIEAWVSYEQELALVVSRDSKGRIRSLPLAETHQKNQVCDWVIAPAAVSQLVEATAYNIAASLLTKLSYVGVMTLEFFYGSSGLFVNEVAPRTHNSGHFSIEACSSSQFDQQLCIAAGLDVPNPDLIADGSLMVNLLGLSQDHAEPLEERLAKLRSMKELHLHWYGKDEIPGRKLGHVTTLLKGHSAAERAEIGQQMLQSIREIWPLPLNW

SEQ ID NO: 13928 - DNA, 1149 bp, Alkalilimnicola ehrlichei MLHE-1
  CDS (1)..(1149): transl_table=11
atgagcaagatactgttgccgggggccaccctgggggtgctgggcaacggccagttgggccggatgttcgccctggccgcgcgtcgcatgggctatcgggtggcgtgcttcggcccgggccgggacagtcccgccggacaggtctgcgacatcgaggtgaccgccgactaccgcgatgagcaggccctgcgtgactttgcccgccgggtggatggggtcacctttgagttcgagaatgtgccggccgaggccggtgatctgctggccgggtacgtcccggtccgcccccaccatacggtgctgcacgtggcccagaaccgttggcgggaaaagacttggctgagcgagcagggctttccggtgggggcctttgccaccgtggagcgggaggaggaactggctgccgccctcgaacgggtgggcacgcccgcggtgctgaagaccgccggctttggctatgacggcaaaggccaagcgttgattcgggagccttccgaggccgcctgggcgtgggcggcgatcggggggcaggcggcggtgctggaggccttcgtggatttccacatggaggtctcgatggtggccgcccgcggcttggacggcagcttcacccactacggcgtgctggagaaccgccaccgtgatcacatcctcgatctcaccctgccggaggccccgctggggccgcagcttcgtgagcaggcggaggatgtcacccgcggcatcctcgaggcgctggatgtggtcggggtgctctgcgtggagttttttgtcgccagtgacggacggctgctggtcaatgagctggccccgcgcccccataactccggccacctgaccttcgatgcggcgatgaccagccagtttgagcagcaggtgcgcgccctttgcgggctgcccttgggggacagccgattgctgcggccggcggccatggtgaacttgctgggggatctctggggcgatggcgagccggattgggccgcggcgctcaaggacccggaggtcaagctccacctctacggcaaggccgaggccaagccggggcggaagatgggccacgtcactgccttcggtgaggaccgcgatgacgcggcgcggcgggccctgagcgcccgtgagcggctgcaagcgggcgccggaggctga

SEQ ID NO: 13929 - protein, 382 aa, Alkalilimnicola ehrlichei MLHE-1
MSKILLPGATLGVLGNGQLGRMFALAARRMGYRVACFGPGRDSPAGQVCDIEVTADYRDEQALRDFARRVDGVTFEFENVPAEAGDLLAGYVPVRPHHTVLHVAQNRWREKTWLSEQGFPVGAFATVEREEELAAALERVGTPAVLKTAGFGYDGKGQALIREPSEAAWAWAAIGGQAAVLEAFVDFHMEVSMVAARGLDGSFTHYGVLENRHRDHILDLTLPEAPLGPQLREQAEDVTRGILEALDVVGVLCVEFFVASDGRLLVNELAPRPHNSGHLTFDAAMTSQFEQQVRALCGLPLGDSRLLRPAAMVNLLGDLWGDGEPDWAAALKDPEVKLHLYGKAEAKPGRKMGHVTAFGEDRDDAARRALSARERLQAGAGG

SEQ ID NO: 13930 - DNA, 1080 bp, Hyphomonas neptunium ATCC 15444
  CDS (1)..(1080): transl_table=11
atgagcccgcttcgccccggcgcgacgatcgggatattgggcggcgggcagcttggccggatgctggcgagcgcggccgcgcagcttggctttgatgtgctgatctattcgcccgaagatgatccgccggcaggtcgtgtcgcggcgggggcctttcaggccgactgggacgacgccgaggcgctgaccgagtttgcccaggcctgcgatgtgatcacgctggaatttgaaaatgtggcggtcgcgagcgttgaggtgatcgagaagaccggaaagcgcgtgctgccgggggcgaagtctctctccgtgtctcaggaccggatgaccgagaagacctttctcaacgcgcacggcatccccacagcgccgttccgcgagattaattcggcggctgatatttccgccgctttggcgagcctcggcggcaaaggcgtgttgaagacgcgccgcgaaggctatgacggcaaggggcaggcctgggtttacgatgcggccgaagccgaaaaggcctgggcgaagattggcgcgatgccggcgatcctggaaggcgccatcgcatttgagtgcgaaatctcggtgctggtggcgcgcagcgttacaggcgaaacgaccagctgggcgccgccgcgcaacagccatgagaacgggattctcgcgcgctcggttgtgccgtctggcctcagcaaagcggtggaagacgaagcgcgcgccaaggcgatgcatctggccgatgagctgggccatgtgggcgttctggcgctggagttttttgttttgccggatggcacgctgctggccaacgaatttgcgccccgcgtgcacaattccggccattggacgcctgaagcctgccagaccgggcagttcgagcagcatatccgctgcgtggccggttggccgctgggggatacgcaccggctgtttgatgccgagatggcgaacctgatcggtgacgaggggctggttgacccggcaacgctcaaggcgaatgatgttttgaccctttacggcaagcgcgaagcccggcccggacgcaagatgggccatatcacgcgccgccttggcccacgaaaggactag

SEQ ID NO: 13931 - protein, 359 aa, Hyphomonas neptunium ATCC 15444
MSPLRPGATIGILGGGQLGRMLASAAAQLGFDVLIYSPEDDPPAGRVAAGAFQADWDDAEALTEFAQACDVITLEFENVAVASVEVIEKTGKRVLPGAKSLSVSQDRMTEKTFLNAHGIPTAPFREINSAADISAALASLGGKGVLKTRREGYDGKGQAWVYDAAEAEKAWAKIGAMPAILEGAIAFECEISVLVARSVTGETTSWAPPRNSHENGILARSVVPSGLSKAVEDEARAKAMHLADELGHVGVLALEFFVLPDGTLLANEFAPRVHNSGHWTPEACQTGQFEQHIRCVAGWPLGDTHRLFDAEMANLIGDEGLVDPATLKANDVLTLYGKREARPGRKMGHITRRLGPRKD

SEQ ID NO: 13932 - DNA, 1077 bp, Rhizobium leguminosarum bv. viciae 3841
  CDS (1)..(1077): transl_table=11
atgacggcaagaacgatcggcattatcggcggcggccagctcggccgcatgctggccattgccgccgccaggttgaattttcgcacggtcatcctcgagccgcaggcagactgcccggccgcccagctcgccaaccggcagattaccgccgcctatgacgatccggcggcactggccgaactcgccgatatctgcgacgtcgtcacctacgaattcgagaacgtgcccgtcgtagccgccgaaacgctctcggcgagcgtgtccgtctatccgccgccgaaggcgctggaagcagcccaggaccgccttgtcgaaaagcgctttctcaatggctgcggcataaccactgcccgtttccacacgatcgacagccagtccgacctcgatacggcactgaaggatttcggcggccagggcgtgctgaagacccgccgtcttggttatgacggcaagggccagaaagttttccgctcggccgcagacagtccggatggcgcctatgcagcacttggcggcgtgccgctcatcctcgaaagcttcgtcgccttcgagcgtgaggtctcgatcattgccgcccgcgccatcgacggtacggtcgcctgcttcgatcccgccgagaatgtccaccgaaatggcatactccacacctcgacggttcccgctgcgatctctgcagcgacggcggacgccgcgcggcaatcggcggagaaaatccttgctgcattgaactatgtcggcgtcatcggcatcgaattcttcgtgcttgccgatggcggtctgattgccaacgagatggcaccgcgtgtccacaactccggtcactggacggaagccgcctgcgtcgtcagccagttcgagcagcatatccgcgccgtcgccggcctgccgctcggcaatgccgagcgccattccgactgcgtcatgcagaacctgatcggcgacgatatccttgccgttcccgactggctgcggcaccccgatacgctggttcatctctatggcaagaccgagtggcgccccggccgcaagatgggccatgtcaccaccttgatgccgaaatcgccggttttggcctga

SEQ ID NO: 13933 - protein, 358 aa, Rhizobium leguminosarum bv. viciae 3841
MTARTIGIIGGGQLGRMLAIAAARLNFRTVILEPQADCPAAQLANRQITAAYDDPAALAELADICDVVTYEFENVPVVAAETLSASVSVYPPPKALEAAQDRLVEKRFLNGCGITTARFHTIDSQSDLDTALKDFGGQGVLKTRRLGYDGKGQKVFRSAADSPDGAYAALGGVPLILESFVAFEREVSIIAARAIDGTVACFDPAENVHRNGILHTSTVPAAISAATADAARQSAEKILAALNYVGVIGIEFFVLADGGLIANEMAPRVHNSGHWTEAACVVSQFEQHIRAVAGLPLGNAERHSDCVMQNLIGDDILAVPDWLRHPDTLVHLYGKTEWRPGRKMGHVTTLMPKSPVLA

SEQ ID NO: 13934 - DNA, 1083 bp, Pseudomonas aeruginosa UCBPP-PA14
  CDS (1)..(1083): transl_table=11
atgaaaatcggtgtcatcggtggcggccagctgggccgcatgctggccctggcgggaaccccgctgggcatgaacttcgctttcctcgacccggcgccggacgcctgcgcggcctccctgggcgagcacatccgcgccgactacggcgaccaggagcacctgcggcaactggccgacgaggtcgacctggtgaccttcgagttcgagagcgtgccggcggaaaccgtggccttcctctcccagttcgtgccggtctacccgaacgccgagtcgctgcgcatcgcccgcgaccgctggttcgagaagtcgatgttcaaggacctcggcattcccaccccggacttcgctgacgtccagtcccaggctgacctcgatgccgccgcggccgccatcggcctgccggcggtgctcaagacccgcaccctgggctacgacggcaagggccagaaggtcctgcgccagccggccgacgtgcagggcgcgttcgccgaactgggcagcgtgccgtgcatcctcgagggcttcgtgccgttcaccggggaagtctcactggtggcggtgcgtgcccgcgatggcgagacgcgtttctacccgctggtgcacaacacccacgacagcggcatcctcaagctctccgtggccagcagcgggcatccgttgcaggcgctggccgaggactacgtcggccgcgtgctggcccggctcgactacgtcggcgtgctggccttcgagttcttcgaggtggacggcggcctgaaggccaacgagatcgccccgcgcgtgcacaactccgggcactggaccatcgaaggcgccgagtgcagccagttcgagaaccacctgcgcgccgtcgccggcctgccgctgggctcgaccgccaaggtcggcgagagcgcgatgctcaatttcatcggcgcggtgcccccggtggatcaggtggtcgccgtcgccgattgccacctgcatcactacggcaaggccttcaagaacggccgcaaggtcggccacgccaccctgcgctgtgccgaccgggcgacgctgcaggcgcgcatcgccgaggtcgaggcgctgatcgaggcgtga

SEQ ID NO: 13935 - protein, 360 aa, Pseudomonas aeruginosa UCBPP-PA14
MKIGVIGGGQLGRMLALAGTPLGMNFAFLDPAPDACAASLGEHIRADYGDQEHLRQLADEVDLVTFEFESVPAETVAFLSQFVPVYPNAESLRIARDRWFEKSMFKDLGIPTPDFADVQSQADLDAAAAAIGLPAVLKTRTLGYDGKGQKVLRQPADVQGAFAELGSVPCILEGFVPFTGEVSLVAVRARDGETRFYPLVHNTHDSGILKLSVASSGHPLQALAEDYVGRVLARLDYVGVLAFEFFEVDGGLKANEIAPRVHNSGHWTIEGAECSQFENHLRAVAGLPLGSTAKVGESAMLNFIGAVPPVDQVVAVADCHLHHYGKAFKNGRKVGHATLRCADRATLQARIAEVEALIEA

SEQ ID NO: 13936 - DNA, 1140 bp, Pediococcus pentosaceus ATCC 25745
  CDS (1)..(1140): transl_table=11
gtgaaaagcaattctgaaaaagggattattttaccaccggcaacaattgggattattggtggtggacagttaggtcaaatgatggcgttagcggctaaagctatgggatataaggtgggggttctagatcctacgcgagattgcccaaccagccaagtttgtgattttcagattgtagccgaatatactgaccatcacgccttaatgcaaatggcggagcagagcgatgttttaacttatgaatttgagaatgttgatttagctagtttgaaagtagcacaagaattggtaaccattccgcagggaaccaacttactagctattactggagaccgaatccgagaaaaaaattttttgagtagtcatggaattccggttacctcctatcaagttgttgaaaagcctactgatttagaaatggcaattgctaaattaggttatccaagcattttgaaaactagtgaaggaggttacgacggacatggacaacaagatattaattccgaagcggatttacttgctggacaacgtttagtagcccaagctccatgtatattggaacaacgtcaaaattttactaaagaattatctgtcatggtaacgcgcagccgcgaaggaatcgtccaatgttttccagtagccgagaatgaacatcagcaccacattctacatcaaagcattgtaccagcccgggtttctcaaaacgtacaagataatgctcgaaaaattgctcaaaaaattgctcagaaattagaactaaggggcgttttaggaatcgaattttttatgctagaaaatggccaattattggttaatgaaatggcaccaaggccacataattcgggacattattccatcgaagcatgtaatatttcgcagttcgaagcccacattcggagtatttgtggattggctttaccaaaagtcacacaaactacaccagcggtgatggtaaatcttctcgggcagcaccttgaagctgctcgtcagaagttagttcaaagacccgattggcattttcatgactatgggaaagtcgaaagtcgagtgaatcgaaaaatgggacacatcacaatattaggtgatattcaaaaaagcttagattcaattaaatcagaaaacatttgggagataaaataa

SEQ ID NO: 13937 - protein, 379 aa, Pediococcus pentosaceus ATCC 25745
MKSNSEKGIILPPATIGIIGGGQLGQMMALAAKAMGYKVGVLDPTRDCPTSQVCDFQIVAEYTDHHALMQMAEQSDVLTYEFENVDLASLKVAQELVTIPQGTNLLAITGDRIREKNFLSSHGIPVTSYQVVEKPTDLEMAIAKLGYPSILKTSEGGYDGHGQQDINSEADLLAGQRLVAQAPCILEQRQNFTKELSVMVTRSREGIVQCFPVAENEHQHHILHQSIVPARVSQNVQDNARKIAQKIAQKLELRGVLGIEFFMLENGQLLVNEMAPRPHNSGHYSIEACNISQFEAHIRSICGLALPKVTQTTPAVMVNLLGQHLEAARQKLVQRPDWHFHDYGKVESRVNRKMGHITILGDIQKSLDSIKSENIWEIK

SEQ ID NO: 13938 - DNA, 1119 bp, Oenococcus oeni PSU-1
  CDS (1)..(1119): transl_table=11
atgattaaaagaacgattttaccaccggcaacaatcggaattattggtggtggacaattgggacaaatgatttcactgtcagctaaatcaattggttatcatgttggtattttggatcctactgaacagtgtccggccgggcaggtttctgattttcagatcgtggccgggtatggtgatgaagcggcattaaccgagttggctgaaaaatcggatctgctgacttatgaatttgaaaatgtcgatcaagatgctttggcacgtgttcaaaaaagaaccggggtcctagtccctcaaggtgtcaaattgttgacggtgacttcaaatcgaatcaacgaaaaaaattttcttcgaacacacggcttgccgacaaccgattttgcaaaagttgcttcgcccgcggaactcaaagtagcggtaaaagagcttggctttccagcaattttaaaaactgtttctggcggttatgacggtcacgggcagtgggacatcaattcggaacaggatgttaaaaatatgcttgaaaaatggccaaaaaatctgctagctattttagaaaaaagggttgatttcgttaaagaaatttctgtcatggtttctcgtgataattgtgatcaagttaaactctggcctattaccgagaatcaacataaaaatcatatcctgcatctttcctatgctcctgcttctattacagattccgtagttcaatcggttaaaaaagaagttagcaaattagcaaacgaaattaatttgtacggtgttttgggagttgaaatgtttcttcgccctgatggaaaaattttaattaatgaattggcgccaaggccgcataattccggtcatctgacgatcgaaggctgcaatatatcacaatttgaaggtcatgttcgttcaatttgcggattgccgattcaaggcccacttctaataaaacccgctttgatgcgaaacttattgggcgacgatctggctaaagctcgaaatgatcttgtcaatcatcctgaatggtatttccacgattatggaaaagcggaaattagaccgcaaagaaaaatgggtcacataactgttttaggcgatgaggcaattaaaaagttgaaagtgtggaataaatga

SEQ ID NO: 13939 - protein, 372 aa, Oenococcus oeni PSU-1
MIKRTILPPATIGIIGGGQLGQMISLSAKSIGYHVGILDPTEQCPAGQVSDFQIVAGYGDEAALTELAEKSDLLTYEFENVDQDALARVQKRTGVLVPQGVKLLTVTSNRINEKNFLRTHGLPTTDFAKVASPAELKVAVKELGFPAILKTVSGGYDGHGQWDINSEQDVKNMLEKWPKNLLAILEKRVDFVKEISVMVSRDNCDQVKLWPITENQHKNHILHLSYAPASITDSVVQSVKKEVSKLANEINLYGVLGVEMFLRPDGKILINELAPRPHNSGHLTIEGCNISQFEGHVRSICGLPIQGPLLIKPALMRNLLGDDLAKARNDLVNHPEWYFHDYGKAEIRPQRKMGHITVLGDEAIKKLKVWNK

SEQ ID NO: 13940 - DNA, 1110 bp, Leuconostoc mesenteroides subsp. mesenteroides ATCC 8293
  CDS (1)..(1110): transl_table=11
atgacaggagtaattttaccgccggcaacgattggtattattggcggtggccaacttggtcaaatgatggctctttctgcaaaagaaatggggtaccgtgttggaattttggatcccacgaaaggctctccagctgggcaagtatcagattttcagatagttgctgattatgatgatgtcgaagcattaaatgaattatcacgacgaagtgaagtgttaacatatgaatttgaaaatgttgatcgagatgcattgaatgagcaaagcgatgcagaattgccgcaaggtacagaactactaagaattacaagcgatcgcattactgaaaaaaagtttattcgggatgatgctaaagtaccagtcacaaatttcattgaagtaaattcacccgaagatttacgaaaggtaactttaccagctatcttaaaaacagtgagtggaggatatgatggccatggtcagtggtcaattaatacagtgcaagatattgttaatcttgaaaaagattttccagatatgcaattaattttagaacaagttgtgaattttaaacaagagctaagtattatggtttcacgttcccaagatgggcaaattgtgacctggccgattgtcgaaaatgttcatgaaaatcacattttaaaaacgacaacagcacctgctgacatctcattgacactcaagaataaaattgaagcaattgctgagaatatcgctgagtcacttaaattgcgtggcgtacttggtattgagttatttgtcgctgacgaggaagtatgggttaacgaattagcaccgcgaccacataattctggacattatagtattgaagcgacaaatgtatcacagtttgaaggacatattagaagtattgtcggtctacctataccaaaaattgagttgcaaagccctgctacaatgttgaatttgttgggcgatgagttaacacaagctagagaagatttaattcatcatcctgagtggcattttcacgattatggtaaattggctgttaaacctaatcgtaaaatgggtcatattacggtactaggaacagaaaatggtcgaaaattaaaagaatggggtgacttgcatgagcagcgcaactga

SEQ ID NO: 13941 - protein, 369 aa, Leuconostoc mesenteroides subsp. mesenteroides ATCC 8293
MTGVILPPATIGIIGGGQLGQMMALSAKEMGYRVGILDPTKGSPAGQVSDFQIVADYDDVEALNELSRRSEVLTYEFENVDRDALNEQSDAELPQGTELLRITSDRITEKKFIRDDAKVPVTNFIEVNSPEDLRKVTLPAILKTVSGGYDGHGQWSINTVQDIVNLEKDFPDMQLILEQVVNFKQELSIMVSRSQDGQIVTWPIVENVHENHILKTTTAPADISLTLKNKIEAIAENIAESLKLRGVLGIELFVADEEVWVNELAPRPHNSGHYSIEATNVSQFEGHIRSIVGLPIPKIELQSPATMLNLLGDELTQAREDLIHHPEWHFHDYGKLAVKPNRKMGHITVLGTENGRKLKEWGDLHEQRN

SEQ ID NO: 13942 - DNA, 1146 bp, Solibacter usitatus Ellin6076
  CDS (1)..(1146): transl_table=11
atgaagcccgtcctccccggcgccaccgtcggcatcctcggcggcggacagctcggacgcatgttcgccatcgccgctcgccgcatgggctatcgcgtacacacgttcgcccccgatgtcgatacccccgccggccagatctccgacgttgaaatccacgcgccctacgaggatctcgataccgtccgcgccttcgcccgcagagtcgacgtggtcaccttcgaattcgagaacgtgcctgccgccactgccgcggccgccgccgaattcgcgcccgtccgtcccgccggcgccgtgctccacaccacccagcaccgtctccgcgagaagctcttcctgcagggcgccggactcccgctcgcaccattccgcatcgtccgcaccgccggcgatctcgctcgcgcggtcgccgatctcggctgccccgccgtcctcaaaacagccggcttcggctacgacggtcacggccaggtgcgtatcacgtcagccgacaccgccctcgccgcctggcaatccatcggctcccaggaagccgtgctcgaggccttcatcgatttcgagtgcgagctctccgtggtcgcggcgcgcgccgccgatggcgccttcgtgcattacggcgtggtggaaaaccgccaccagcgccacatcctcgatatcaccattgcgcccgccaccgtggcgccgcaggtcgcgccccgggccatcgaaatcgcgcgcatcgtgatggagacgctggacgccgtcggcgtactctgcgtcgaattcttcctgacccgcgccggcgacctgctcatcaacgagctcgccccgcgtccgcacaactccggccacttcaccttcgacgcctgcgttaccagccagttcgaacagcagctccgcgccgtctgtggcctgccgctcggctccacggaacagatgcggcccgccgccatggccaacctgctcggcgatctctggaccgccggcccaccggattgggccgccgcctgcgcattccacggcgtgaagctccacctctatggcaaggccgagcctcgcccaggacgcaaaatgggacacctcaccgcgctcggtcccgaccaggccactgcgctaaagacggtcctcgacgcgcgagactccatggtcggcgttcaccgcacgtag

SEQ ID NO: 13943 - protein, 381 aa, Solibacter usitatus Ellin6076
MKPVLPGATVGILGGGQLGRMFAIAARRMGYRVHTFAPDVDTPAGQISDVEIHAPYEDLDTVRAFARRVDVVTFEFENVPAATAAAAAEFAPVRPAGAVLHTTQHRLREKLFLQGAGLPLAPFRIVRTAGDLARAVADLGCPAVLKTAGFGYDGHGQVRITSADTALAAWQSIGSQEAVLEAFIDFECELSVVAARAADGAFVHYGVVENRHQRHILDITIAPATVAPQVAPRAIEIARIVMETLDAVGVLCVEFFLTRAGDLLINELAPRPHNSGHFTFDACVTSQFEQQLRAVCGLPLGSTEQMRPAAMANLLGDLWTAGPPDWAAACAFHGVKLHLYGKAEPRPGRKMGHLTALGPDQATALKTVLDARDSMVGVHRT

SEQ ID NO: 13944 - DNA, 1194 bp, Mycobacterium avium 104
  CDS (1)..(1194): transl_table=11
atggtcggcggcggccagctcgcccggatgacccaccaggccgcgatcgcgctgggccagtcgctgcgggtgctggccaccgccgccgacgagtcggccgcgctggtcgcgtccgacgtggtgatcggctcgcacaccgacctcgaggacctgcgccgggtggccgcgggcgccgacgtgttgaccttcgatcacgagcacgtgccgggcgaactgctggacaagctggtcgccgagggcgtcaacgtggcgccgccgccgcaggccctggtgcacgcgcaggacaagctggtgatgcggcggcggctggaatccctgggtgtgccggtgccgcggtacgccgagatcaacagcctcgacgagctcgacgccttcgcccggcgggtcggtggcccggtggtggtcaaggcggtccgcggcggctacgacgggcgcggcgtgcggatggcccgcgacccggtgcacgcccgggagatcgcggccgccttcctggccgacggcgtgccggtgctggccgaggaacaggtgagcctgcgccgggagctgtccgcgctggtggcccggtcgccgttcgggcagggcgcggcgtggccggtggtcgagacggtgcaacgcgacggcatctgcgtgcaggtgatcgcgcccgcccccggcctgggcgaggacctggccgccgacgcgcaacggctggcgctgcggctggccggcgagctcggcgtggtcggcgtgctggccgtggaactgttcgaaaccaccgacggcgcgctgctggtcaacgagctggcgatgcgcccgcacaactccgggcactggaccatggacgggtcgcgcaccggccagttcgagcagcacctgcgcgcggtgctggactatccgctcggcgacaccgacgcgctggcgccggtcaccgtgatggccaacgtgctgggcgcccgggagcggccgcggatgagcgtcgacgagcggctgcaccacctgttcgcgcgcatgcccgacgcccgggtgcacctgtacggcaagggggaacgccccggccgcaaggtcggtcacatcaacttcctcggcgacttccccgccgccgacacggccgggctggccgcgctgcggcggcgcgccgagctggcggcgcactggctgtcccacgggcagtggacggacggatgggacccacacgaacaggagcggcatcaatga

SEQ ID NO: 13945 - protein, 397 aa, Mycobacterium avium 104
MVGGGQLARMTHQAAIALGQSLRVLATAADESAALVASDVVIGSHTDLEDLRRVAAGADVLTFDHEHVPGELLDKLVAEGVNVAPPPQALVHAQDKLVMRRRLESLGVPVPRYAEINSLDELDAFARRVGGPVVVKAVRGGYDGRGVRMARDPVHAREIAAAFLADGVPVLAEEQVSLRRELSALVARSPFGQGAAWPVVETVQRDGICVQVIAPAPGLGEDLAADAQRLALRLAGELGVVGVLAVELFETTDGALLVNELAMRPHNSGHWTMDGSRTGQFEQHLRAVLDYPLGDTDALAPVTVMANVLGARERPRMSVDERLHHLFARMPDARVHLYGKGERPGRKVGHINFLGDFPAADTAGLAALRRRAELAAHWLSHGQWTDGWDPHEQERHQ

SEQ ID NO: 13946 - DNA, 1227 bp, Mycobacterium smegmatis str. MC2 155
  CDS (1)..(1227): transl_table=11
gtgccgcgcgcttctcaaaccaattcttccgcagtccccgtggtcgccatgatcggcggtggccagctggcccgcatgacccatcaggccgcgatcgcgctgggacagacacttcgcgtgctggccgtcgacccgaacgaccccgcggcacaggtcagcccggacatcgtgctgggctcacacaccgattacgacgcgctggtgaaggttgcgcaaggtgcgaccgtcgtcacgttcgaccacgaacacgtgcccaccgaacatctcgacagactcgtcgccgacggtgtgacggtcgcccctccgcccgaggcgctggtgcacgcccaggacaagctggtgatgcgtcgtcgtctggccgatctgggggcgcccatcccgcagttcgccgaggtcaccgcggccgacgaagcccaggagttcagccgcgaggtcggcggcgccgctgtgatcaagaccatccggggtggctacgacggccgcggtgtcgtgctgctcgacacacctgaacaggcccgcgaggtggccgcgaagtatctgaccgacggggtgccgatcctgatcgaggaacgcgtcgcgatgcggcgcgaactgtcggcgctcgtcgcgcgctcggcgttcggccagggttcggcgtggccggtggtgcagaccgtgcagcgtgacggcatctgcgtcgaggtgatcgccccggctcccgacctgcccgacgatctggccgcaagcgcccagcagttgggcctgcgtctggccgccgagctgggtgtcatcggtgtgctggccgtcgaactgttcgagaccgtcgacggcaggatcctggtcaacgaactggcgatgcgcccgcacaactccgggcactggaccatggacggcgccgtgaccagccagttcgagcagcatctgcgcgcggtcctggactatccccttggcgagacctccgcgcgcgccgagatcgtcgtgatgtccaacgtgctcggcgcaccggagacaccggcgatgagcctcgacgagcgcatccaccatctgttcgcccgtatgcccgacgccaaggtgcacatgtacggcaagggggagcgtccgggacgcaagctgggccatgtcaaccttgtgggcaaaccgggcgaggacgtggccgccgtgcgcgagcgcgccaatcgcgcctcgcactggctgtcacacgcacagtggaccgacaactggaacgagcatgggacggacaccgaatga

SEQ ID NO: 13947 - protein, 408 aa, Mycobacterium smegmatis str. MC2 155
MPRASQTNSSAVPVVAMIGGGQLARMTHQAAIALGQTLRVLAVDPNDPAAQVSPDIVLGSHTDYDALVKVAQGATVVTFDHEHVPTEHLDRLVADGVTVAPPPEALVHAQDKLVMRRRLADLGAPIPQFAEVTAADEAQEFSREVGGAAVIKTIRGGYDGRGVVLLDTPEQAREVAAKYLTDGVPILIEERVAMRRELSALVARSAFGQGSAWPVVQTVQRDGICVEVIAPAPDLPDDLAASAQQLGLRLAAELGVIGVLAVELFETVDGRILVNELAMRPHNSGHWTMDGAVTSQFEQHLRAVLDYPLGETSARAEIVVMSNVLGAPETPAMSLDERIHHLFARMPDAKVHMYGKGERPGRKLGHVNLVGKPGEDVAAVRERANRASHWLSHAQWTDNWNEHGTDTE

SEQ ID NO: 13948 - DNA, 1200 bp, Nocardioides sp. JS614
  CDS (1)..(1200): transl_table=11
gtgcccagccccggtgagtccagccccgagcgtcggctcggccagcggatggcccccaccctcgccgtgatcggcggcggccagctggcccggatgatggccgccccggccaacgcactcgggctcccgctgcgcctgctggcggagggggagggcgtctcggcggcccaggtgatccccgaccacgtggtcggggactaccgcgacctcgagaccctgcggaaggtcacctccggctgcccggtcgtcaccttcgaccacgagcacgtgcccaccgggcacctccacgcgctggaggaggacggcgtcgcggtgcggcccgggccgcacgccctggtgcacgcccaggacaaggcggtgatgcgagagcgcctcggcgagctcggcgtgccctgcccccgcaacgccctggtcaggaccgtcgaggacgtggcggccttcgggttcccgtgcgtactgaagacctcgcggggcggttacgacggcaagggcgtgtggttcgtccgctcggtcggcgactgcgaggagccgttccgggccgcgctcgaggccgacgtccgcctcgtggccgaggagctcgtcgacttccggcgggagctctcggcgctcgtggcgcgctcgcccagcgggcaggccgcggcgtaccccgtcgtcgcctccacccaggtcgacggcatctgccgcgaggtgatcgcgccggcgcccgacctcgaccccgcgctcgccggccgggcgcaggagatcgcgctgcacatcgccggcgcgctcgacgtgaccggcatcctcgcggtcgagctgttcgaaacccgcgacggccgggtcctggtcaacgagctggcgatgcgcccgcacaacaccgggcactggacccaggacggggcggtcacctcccagttcgagaaccacctgcgcgcggtgctcgacctgccgctcggctcgccgacgccccgggcccggtggacggtgatggtgaacatcctcggcagcgacgacacgagcgtcggcaggctgtacgacggctacccgcacgcgctcgcccgggacccgatgctgcgcgtgcacctctacggcaaggagctgcggccgggccgcaaggtcgggcacgtcaacgcctacggcgaggacctcgacgactgcctcgagcgggcccggcacgccgcggcctggttccgcggtgacctgggagacgagagtgagtaa

SEQ ID NO: 13949 - protein, 399 aa, Nocardioides sp. JS614
MPSPGESSPERRLGQRMAPTLAVIGGGQLARMMAAPANALGLPLRLLAEGEGVSAAQVIPDHVVGDYRDLETLRKVTSGCPVVTFDHEHVPTGHLHALEEDGVAVRPGPHALVHAQDKAVMRERLGELGVPCPRNALVRTVEDVAAFGFPCVLKTSRGGYDGKGVWFVRSVGDCEEPFRAALEADVRLVAEELVDFRRELSALVARSPSGQAAAYPVVASTQVDGICREVIAPAPDLDPALAGRAQEIALHIAGALDVTGILAVELFETRDGRVLVNELAMRPHNTGHWTQDGAVTSQFENHLRAVLDLPLGSPTPRARWTVMVNILGSDDTSVGRLYDGYPHALARDPMLRVHLYGKELRPGRKVGHVNAYGEDLDDCLERARHAAAWFRGDLGDESE

SEQ ID NO: 13950 - DNA, 1182 bp, Azoarcus sp. BH72
  CDS (1)..(1182): transl_table=11
atgtccgaatccgccctgtccgcgcccatcctgccgcccgccacgctgggcatgttggggggaggccagctcggccgcttcttcgtctccgcggcacacgagatggggtacaaggtctgggtgctcgaccctgacccccacagtcccgccgggcgtatcgccgatttccatctcgtcgccgcctatgacgactatgccgcgctcgaccgcgtggcggcggagtgcgccgcggtgaccaccgagttcgagaacgtgcccgccgcgacgctggactatctggcgaagttcgtcccggtgcgacccggggcagccgccgtcgcggtgtgtcagaaccgcatcgaggaaaagggttttctggccggcaacggattgccgcacggcccatatgccgccatccgcagcgatgaggatttgcgcgcggccgacgctgcgctctttcctgcagtgcttaaagtggcgcgcttcggctacgacggcaaggggcaggcgcgggtcgccgacgtggatgaggccttggcggcctttcatcagttcaagggcgagccctgcgtgctggaaaaactgctccggctcgacttcgaactttcggtcgtgctggcgcgcgacgaggcgggcgcggtgcggtgtttcccggccgccgagaatcgtcaccgccgcggcatcctggatgtgacgattgcgcccgcgcaatcggccccggccggcctgcgcgacgaagcgcaggtggtcgcggcgcgaatcgcggagcacctcggctatgttggaacgctgggggtggagttctttgtctgcgagggcgtcctctacgtcaatgagatggcgccgcggccgcacaacagcggccatcacaccatcgacgcctgcgacgtcagccagtacgaccaacaggtgcgcgcgctgtgcgggctgccgctgggcgtgccccgtcagcactccgccgcggcgatggtgaatctgctgggcgagctgtggtacgccgacgggcacgccacgggtgcctaccgtgaaccggactggcgagtgctcgccgacgtgcccggcctgaggctccatctgtacggtaagcaccacgcccgcccggggcgcaagatggggcatttcacggtggtgggcgaggatcaggcggccgtgctggcgcaggccttgcgtgctcgcggcgcgatcggggtgactgacgaatga

SEQ ID NO: 13951 - protein, 393 aa, Azoarcus sp. BH72
MSESALSAPILPPATLGMLGGGQLGRFFVSAAHEMGYKVWVLDPDPHSPAGRIADFHLVAAYDDYAALDRVAAECAAVTTEFENVPAATLDYLAKFVPVRPGAAAVAVCQNRIEEKGFLAGNGLPHGPYAAIRSDEDLRAADAALFPAVLKVARFGYDGKGQARVADVDEALAAFHQFKGEPCVLEKLLRLDFELSVVLARDEAGAVRCFPAAENRHRRGILDVTIAPAQSAPAGLRDEAQVVAARIAEHLGYVGTLGVEFFVCEGVLYVNEMAPRPHNSGHHTIDACDVSQYDQQVRALCGLPLGVPRQHSAAAMVNLLGELWYADGHATGAYREPDWRVLADVPGLRLHLYGKHHARPGRKMGHFTVVGEDQAAVLAQALRARGAIGVTDE

SEQ ID NO: 13952 - DNA, 1182 bp, Mycobacterium sp. KMS
  CDS (1)..(1182): transl_table=11
atgatcggcgggggtcaactcgcccggatgacccaccaggcggcgatcgcgctgggccagactctgcgggtgctcgccaccggcccgcaggagccggccgcccaggtgacccccgacgtggtgatcggatcgcataccgacctcgacgcgctccggcgcgcggccgccggtgcgaccgtactgaccttcgaccacgaacacgtccccaccgaagcactcgagacgctggtggccgagggggtcaacgtggcgccgccgccggccgcgctggtgcacgcgcaggacaagctggtgatgcgcaggcgactcgaagcgatgggtgcgccgatcccgcgctacaccgccgtcgacaccgtcgacgacgtcgtggccttctcgtccgaggtcgatggcccggtcgtgctcaagacggtccgcgggggatacgacggccgcggcgtggtgctgaccgccgacgccgaggaggcgcgcgacgtggccgcccgctacctcgccgacggtgtgccgatcctggccgaggagcgtgtcgacatgcgccgcgagctcgcggccctggtggcccggtcaccgttcgggcagggtgcggcgtggccggtggtcgagaccgtgcagcgcgacggcatctgcgtcgtggtgctggccccggcgccggagttgtccgacgacctgggctcgagcgcccagcagctggggttgaagctggccgccgaactcggcgtggtcggggtgctcgccgtcgaactcttcgaaacggtcgacggccggctgctggtcaacgaattggcgatgcggccgcacaactccgggcactggagcatggacggcgcggtcaccggccagttcgaacagcacgtccgcgcggtgctggactatccgctcggcgacacctcgctgctcgccccggccaccgtgatggccaatgtcctcggggcgccgcagactccggcgatgacgatggacgaacgggtgcaccacctgttcgcccgcatgccggacgccaaggtgcacctgtacggcaagggggagcggcccggccgcaagatcggccacgtcaacctcaccggtgacgatccggcggtgttgcgtgagcgggccgagcgggccgcgcactggttgtcccacgccgagtggaccgacggatgggatccgcacgccgaagtcagggaaggaatctcgaggtga

SEQ ID NO: 13953 - protein, 393 aa, Mycobacterium sp. KMS
MIGGGQLARMTHQAAIALGQTLRVLATGPQEPAAQVTPDVVIGSHTDLDALRRAAAGATVLTFDHEHVPTEALETLVAEGVNVAPPPAALVHAQDKLVMRRRLEAMGAPIPRYTAVDTVDDVVAFSSEVDGPVVLKTVRGGYDGRGVVLTADAEEARDVAARYLADGVPILAEERVDMRRELAALVARSPFGQGAAWPVVETVQRDGICVVVLAPAPELSDDLGSSAQQLGLKLAAELGVVGVLAVELFETVDGRLLVNELAMRPHNSGHWSMDGAVTGQFEQHVRAVLDYPLGDTSLLAPATVMANVLGAPQTPAMTMDERVHHLFARMPDAKVHLYGKGERPGRKIGHVNLTGDDPAVLRERAERAAHWLSHAEWTDGWDPHAEVREGISR

SEQ ID NO: 13954 - DNA, 1137 bp, Neisseria meningitidis FAM18
  CDS (1)..(1137): transl_table=11
atgaaaaacatatctctttctccgcccgccatgcttggcatcctcggcggcggacaattaggcagaatgtttaccgttgccgccaaaaccatgggctacaaagtaaccgttctcgaccccgatccggacgcgccggcagcagaatttgccgactgtcatttatgcgcgccgtttaacgaccaagctgctttggacgaattggcaaaatgcgcggcggtgaccactgaatttgaaaacgtcaatgccgatgcgatgcgttttctcgccaaacacaccaatgtttcccccggcagcgactgcgttgccatcgcgcaaaaccgcattcaggaaaaggcatggatacgcaaagcaggattgcaaaccgcgccgtatcaagcaatttgcaaagccgaagacatcactgaagaaagcatacaatttctgcccggcatcctgaaaaccgctacattgggctatgacggcaaaggccaaatccgcgtcaaaacggtggatgaactcaaagccgcgtttgccgaacaccgcggcgtggattgcgttttggaaaaaatggtggacttgcgcggcgaaatttccgttatcgtatgccgtctgaacaatgacaacgtgcaaactttcgatcctgccgaaaacattcacgaaaacggtatcctcgcctactccatcgtcccagcccgactgagtgccgacattcagcaacaggcgcgacaaatggcgcagcgtttggccgatgaattgaactacgtcggcgtattggcggtagaaatgtttgttgtcggcgacacgcatgaattggtcgtcaacgaaatcgcgccgcgtccgcacaattccggccaccataccgtcgacgcctgcgcggcagaccaattccagcaacaggtccgcctgatgtgcaacctgccacctgctgacaccaaattgctgagttcttgctgtatggcgaatattttgggcgacgtttggcaggaagacggcggcgaaccggattggtttcccctgcaaagccggccggacgcgcacctgcacctttacggcaaaaaaaccgcgcacaaagggcggaaaatgggacactttaccgttttaaccaccgattcggacaccgcatttcaagaagcaaaaaaactgcatcagtccctataa

SEQ ID NO: 13955 - protein, 378 aa, Neisseria meningitidis FAM18
MKNISLSPPAMLGILGGGQLGRMFTVAAKTMGYKVTVLDPDPDAPAAEFADCHLCAPFNDQAALDELAKCAAVTTEFENVNADAMRFLAKHTNVSPGSDCVAIAQNRIQEKAWIRKAGLQTAPYQAICKAEDITEESIQFLPGILKTATLGYDGKGQIRVKTVDELKAAFAEHRGVDCVLEKMVDLRGEISVIVCRLNNDNVQTFDPAENIHENGILAYSIVPARLSADIQQQARQMAQRLADELNYVGVLAVEMFVVGDTHELVVNEIAPRPHNSGHHTVDACAADQFQQQVRLMCNLPPADTKLLSSCCMANILGDVWQEDGGEPDWFPLQSRPDAHLHLYGKKTAHKGRKMGHFTVLTTDSDTAFQEAKKLHQSL

SEQ ID NO: 13956 - DNA, 1176 bp, Acidovorax sp. JS42
  CDS (1)..(1176): transl_table=11
atgaacgagcgccagaccgtgatcctgcccggcgccacgctgggcgtgctgggcggcgggcagctggggcgcatgttcgtacacgcggcccaggccatgggctacttcaccgcggtgctggacgaggacgcggccagccccgccggcctggtgagccaccaccacatccgcaccggctacgaagacccgcagggcctggccacgctggcccgcgcctgcgacgccgtgaccaccgagtttgaaaacgtgcccgccgccgcgctggacaccctggcgcgcagcctgccggtgtcgcccgccggcagcgccgtggccatcgcccaggaccgcgcgcgcgaaaaggcgcacttcgtgcagtgcggcgtgccggtggcgccgcatgcagtgatcgaaaccgccgcgcagctcgccgccgttcccgctgatctgctgccgggcattctgaaaaccgcccgcatgggctacgacggcaagggccaggtgcgcgtggccacgcccgccgagttggccggcgcctgggagcaactgggccgcgtgccctgcgtgctggaaaagatgctgccgctggcgcacgagtgctccgtcatcgtcgcgcgcgggcgtgacggcaccgtggtgcacctgcccgtgcagcgcaacctgcaccgggacggcatcctggccgtgaccgaggtctacgaaggaaatctgcctccagcgcagaccagtcaagcgctgatagctgcgaaatcagtagcaaacggtctgaactacgtgggcgtgctgtgcgtggagttcttcgtgctgcaggacggcacgttggtggtcaacgagatcgccccgcgcccgcacaacagcggccactacagccagaacgcgtgcgacgtctcgcagttcgagctgcaggtgcgctgcatgaccggcctgccgctggtccagccgcgcctgcacagccccgccatcatgctcaatctgctgggcgacctgtggttcacgggggaccagcccgtggcgccgactgcccccgcgtgggatgcggtgctggccctgccgggctgccacctgcacctgtacggcaaggtggaggccaagcgcggccgcaagatgggccacctgaacatcaccggcaccacgcccgaggcggtgcgcgccacggcgctgcaggcggcggccctcctcggcatcgcgccgttctga

SEQ ID NO: 13957 - protein, 391 aa, Acidovorax sp. JS42
MNERQTVILPGATLGVLGGGQLGRMFVHAAQAMGYFTAVLDEDAASPAGLVSHHHIRTGYEDPQGLATLARACDAVTTEFENVPAAALDTLARSLPVSPAGSAVAIAQDRAREKAHFVQCGVPVAPHAVIETAAQLAAVPADLLPGILKTARMGYDGKGQVRVATPAELAGAWEQLGRVPCVLEKMLPLAHECSVIVARGRDGTVVHLPVQRNLHRDGILAVTEVYEGNLPPAQTSQALIAAKSVANGLNYVGVLCVEFFVLQDGTLVVNEIAPRPHNSGHYSQNACDVSQFELQVRCMTGLPLVQPRLHSPAIMLNLLGDLWFTGDQPVAPTAPAWDAVLALPGCHLHLYGKVEAKRGRKMGHLNITGTTPEAVRATALQAAALLGIAPF

SEQ ID NO: 13958 - DNA, 1155 bp, Nostoc punctiforme PCC 73102
  CDS (1)..(1155): transl_table=11
atgaaacgtgttggtgtaattggtggtggacaacttgcctggatgatggcggatgcagcacagaagctaggagtagaattagtagtacaaactcctagcgaacacgacccggccgtgtcaatcgctcaggaaactgtcttcgcaccagttgatgacgcaagtgctacagaaatattagctcaaaaatgcgatgtcatcacctttgaaaatgaatttgttaatctacaagctttatctcttttagcacagcaaggcgtttgtttccgtcccagcttagaagctttagctccacttttagataaatatcatcagcgttgctatttacgcgatttgagcttaccagttcctcagtttttcgcccttgacgaggtggaaaatctccaatcaaaaatagaatatctaggttttccagcagtcctcaaagcccgccgccacggttatgatggtcagggtactttcataattccagattttggtactttagagcaaaagctaagttatggaactataacaaaacctttaaatgaatcatttttcttgttagaagaatttgtcccttttgaaagagaactagcaataattgcagcgcgttctgtggagggagaaattgtaacttacccagtagtggaaacccaacaagaacaacaagtctgtcggcgggtaattgcgcctgctgatattacacccaatcaagtagcagaaatagaagcgatcgcacatactctattaaatagcctaaaagtagtcggaatttttggaattgagctatttctcagcgctgatggcaaagtgctggtaaatgaaattgcgcctcgtacccacaattctgggcatttttctattgacgcttgtgaaacttctcaatttgaacagcacctcagagcagtttgtggtttacctttagggaatccagctttgcagtgcgctggcgctgtaatggtcaacctactggggtatgaaaattctcacagcgactaccaaagccagcgtcaacaaatagcggagattccccaggcgcaccttcactggtatgggaagacagaatcacgtcctgggcggaagttagggcatgttaccgttttactggataatcagaatagagaatcggcaaatgccatcgcccacaccatagaatctatctggtatcccaggtaa

SEQ ID NO: 13959 - protein, 384 aa, Nostoc punctiforme PCC 73102
MKRVGVIGGGQLAWMMADAAQKLGVELVVQTPSEHDPAVSIAQETVFAPVDDASATEILAQKCDVITFENEFVNLQALSLLAQQGVCFRPSLEALAPLLDKYHQRCYLRDLSLPVPQFFALDEVENLQSKIEYLGFPAVLKARRHGYDGQGTFIIPDFGTLEQKLSYGTITKPLNESFFLLEEFVPFERELAIIAARSVEGEIVTYPVVETQQEQQVCRRVIAPADITPNQVAEIEAIAHTLLNSLKVVGIFGIELFLSADGKVLVNEIAPRTHNSGHFSIDACETSQFEQHLRAVCGLPLGNPALQCAGAVMVNLLGYENSHSDYQSQRQQIAEIPQAHLHWYGKTESRPGRKLGHVTVLLDNQNRESANAIAHTIESIWYPR

SEQ ID NO: 13960 - DNA, 1179 bp, Bifidobacterium longum DJO10A
  CDS (1)..(1179): transl_table=11
atgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtctgacgtgctcacctacgagttcgagaacgtggacgccggcgccatcgacgaggtgcgcggcatcaccgccaccccgcagggcaccgacttgctgcgcgtgacccagcaccgcgtgcgcgagaagcggttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcccctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtga

SEQ ID NO: 13961 - protein, 392 aa, Bifidobacterium longum DJO10A
MPSLSEETGGRVSMLMPGSTIGIIGGGQLGRMMALSARYMGFRVGVLDPTPNCPTGQVADFQITAEYDDKTAIHDLAVQSDVLTYEFENVDAGAIDEVRGITATPQGTDLLRVTQHRVREKRFINDHGTATAPWRAVNNFDELDAALGDIHYPAVLKTVSGGYDGHGQLVLRSDADLEKIRSRSDRGGGFPPSILEGFVDFAFEASILVSGNGKDFVTFPIVRNEHRNNILHMTIAPAEVSEHVAREAHELAIRLAKGFELAGTLAIELFITKDDQVIVNELAPRPHNSGHYTIEACSMDQFDAHIRGIAGWPLPKPKLLSPAVMVNVLGQHVEPTRALIATHPEWNVHDYGKAEVRHDRKMGHITVLTDDPAKTVADLEATGCWDDLKKKA

SEQ ID NO: 13962 - DNA, 1089 bp, Haemophilus somnus 2336
  CDS (1)..(1089): transl_table=11
atggtaaaccgcactttatatcctacagtgtatgttttaggtaatgggcaattgggcagaatgttgcgttatgcgggtgcacctttagatattaatgtccaacctcttgcttttgatgcacctgtttttgatttgcctgctgacagtattattacagcagaaattgagcgttgggaaaaaacaccccttacagaaatgttggctaatcacgataaatttattaatcaaaaaatttttgccactacagcagatcgttttacacaaaaaaccttgcttaacgcactaaatattcctacttccccttggaggttggtacaaagtgcggaggattttttcactatttttacagaaattggtgaaaaagttgttgtaaaacgtcgcatgggaggttacgacggacgaggacaatggattgtagataaaaataatcaagatgtaatcggcaatgagctttttggcgaagttattgccgaaaaatttattccttttgattatgaaatttctttggttggtgcaaggtttaaaaatggcaaaactcgtttttatcctgttacgcataatctgcaacagaatggtattttacgttacagcgtcatgaatttaaattttccacaacaatcacaacaacaaaaacaagccgaaataatgttggctaaaattatggataaattagattatgttggcgtaatggcaatggaatgttttgttgtgcaagatcaattattagtcaatgaattggcaccaagagtacataatagcggacattggacgcaattaggttgttcgattagccaatttgaattacatcttcgtgcgttattagatttacctacgcctgatttacaagtggctatgccgtcggttatggtgaatttaattggcactgaacataatctacaatggttaaatttgccattttcacaattacattggtatggaaaagaagtacgagaaggtcgtaaagttgggcatcttaatttatctcatccaactccgtctattttaatagataatttacaaaaattacgctacatactaccgcaagattatcaatttggtttagattgggcattagaaaaattgaaataa

SEQ ID NO: 13963 - protein, 362 aa, Haemophilus somnus 2336
MVNRTLYPTVYVLGNGQLGRMLRYAGAPLDINVQPLAFDAPVFDLPADSIITAEIERWEKTPLTEMLANHDKFINQKIFATTADRFTQKTLLNALNIPTSPWRLVQSAEDFFTIFTEIGEKVVVKRRMGGYDGRGQWIVDKNNQDVIGNELFGEVIAEKFIPFDYEISLVGARFKNGKTRFYPVTHNLQQNGILRYSVMNLNFPQQSQQQKQAEIMLAKIMDKLDYVGVMAMECFVVQDQLLVNELAPRVHNSGHWTQLGCSISQFELHLRALLDLPTPDLQVAMPSVMVNLIGTEHNLQWLNLPFSQLHWYGKEVREGRKVGHLNLSHPTPSILIDNLQKLRYILPQDYQFGLDWALEKLK

SEQ ID NO: 13964 - DNA, 1089 bp, Haemophilus influenzae R2846
  CDS (1)..(1089): transl_table=11
atgcaaaactccaccttatacccaacggtttatgtacttggcaacggacaactcggcagaatgttaggttacgcaggcacacctttagatatttatgttgaacctttagccttcaatgcgccagtttttgacttacctgaaaatgcgatcatcacggcagaaattgaacgctgggaaaaaacgcctttgactgaattactcggcaatcataaaaacttcgtcaatcaacatgtatttggattattggcagatcgttttactcaaaaatccttacttgatgaactcaatctttcgacctcgccttggtgtttattaaaagataaaacgcaatggaatgatattttccaaactgttggcgagaaagttgtcgtcaaacgtaaaacaggcggatatgatgggcgtggtcaatggattatcagcgatgaaaataaagcggacatcaccgatgacttatttggtgaagtgatcgcagaaaaatttattccttttgattatgaaatttctattgtaggcgcaagatttaaaaatggcgaaaagcgtttttatcccgttacgcataacctgcaacaaaacggtattttgcgttacagtgtggttgatagtgcatttcctcaacaatccgcacaacaaaaacaagctgaaacaatgctcggcaaaattatggataaattaggctatgtgggtgtcatggcaatggaatgttttgttgttggcgacaaattactgattaacgaacttgcgcctcgcgtacataacagtggacattggacacaactaggatgtgctattagtcaatttgaattacatttacgtgctctacttgatttgccaacacctgaattacaaacattctccccaagtgtgatggtgaatttaatcggcacaaaccataatcccaaatggcttaatataccttttgcacaacttcattggtacggtaaagaagtgagggctgggcgtaaggttgggcatatcaatctttctcatcccaataaagcagtcattattcaacaattagaaaaacttcgctctgagttacccgaagattatcaatctggattaaattgggcgattgaaaaactaaaataa

SEQ ID NO: 13965 - protein, 362 aa, Haemophilus influenzae R2846
MQNSTLYPTVYVLGNGQLGRMLGYAGTPLDIYVEPLAFNAPVFDLPENAIITAEIERWEKTPLTELLGNHKNFVNQHVFGLLADRFTQKSLLDELNLSTSPWCLLKDKTQWNDIFQTVGEKVVVKRKTGGYDGRGQWIISDENKADITDDLFGEVIAEKFIPFDYEISIVGARFKNGEKRFYPVTHNLQQNGILRYSVVDSAFPQQSAQQKQAETMLGKIMDKLGYVGVMAMECFVVGDKLLINELAPRVHNSGHWTQLGCAISQFELHLRALLDLPTPELQTFSPSVMVNLIGTNHNPKWLNIPFAQLHWYGKEVRAGRKVGHINLSHPNKAVIIQQLEKLRSELPEDYQSGLNWAIEKLK

SEQ ID NO: 13966 - DNA, 1134 bp, Listeria monocytogenes str. 4b H7858
  CDS (1)..(1134): transl_table=11
gtgattatcttggataaaaaatttttactgacaaatagtactattggtattattggtggcggacaacttggacgtatgcttgctcttgcggcgaaagcgatggggtatcgtattattgttcttgatcctaccgctgattgcccagctgctcaagtaagtgatgaacaaattattgctgactatgatgataaagtagcattacgcgaactttccgaaaaagcagatgtagttacatatgaatttgaaaatatcgactatgatgctttgaaaatgacgcaaaacttagtatctgtcccgcaaggatcggaattgctttcgattacacaggataggattttggaaaaagcttatctggaatcagctaatattaacattgcgccgtatgcggttatagtggaacaagatgaaattgaaaatgaaattaaaagtattggatatcctgctgttttaaaaacggcacaaggtggatacgacgggaaagggcaagtggttattcatgatgcaagggatattgaaacagcagcgagattgttgcgatacggctcttgtgtactagaagcttggattccttttgaaaaagagatttctgtggttgtcgctcgtaatttagaagggcaaatagaaacttttccagttgcagaaaatgtacatgtaaataatattttgcatacaactacggctcctgcagatgtggcggatgacgtgcatgaggaagcggaagaaattgcgagaaagttagcagatgtacttcaattatgtggtgttttagcagtagaaatgtttgtgacaaaatcaggggctatttatgtaaatgaacttgctccaagacctcataattctgggcattttacaattgaagcttgttctatttctcagtttacgcagcatattcgagcgattgttggattgccacttgtaaaaccagaactcttaaaaccagccttaatgattaatattttagggcaacatgtcgatgcagtgaataaacaaatggtgaattatccacattggtttgtacattattatggaaaaaaagaagcgaaaatcaatcgcaaaatgggtcatgttactgtgcttgctgatgaaccaaaagcggttatacaagatttagaagaaacgcaaatttggaagtaa

SEQ ID NO: 13967 - protein, 377 aa, Listeria monocytogenes str. 4b H7858
MIILDKKFLLTNSTIGIIGGGQLGRMLALAAKAMGYRIIVLDPTADCPAAQVSDEQIIADYDDKVALRELSEKADVVTYEFENIDYDALKMTQNLVSVPQGSELLSITQDRILEKAYLESANINIAPYAVIVEQDEIENEIKSIGYPAVLKTAQGGYDGKGQVVIHDARDIETAARLLRYGSCVLEAWIPFEKEISVVVARNLEGQIETFPVAENVHVNNILHTTTAPADVADDVHEEAEEIARKLADVLQLCGVLAVEMFVTKSGAIYVNELAPRPHNSGHFTIEACSISQFTQHIRAIVGLPLVKPELLKPALMINILGQHVDAVNKQMVNYPHWFVHYYGKKEAKINRKMGHVTVLADEPKAVIQDLEETQIWK

SEQ ID NO: 13968 - DNA, 1134 bp, Listeria monocytogenes str. 1/2a F6854
  CDS (1)..(1134): transl_table=11
gtgattatcttggataaaaaatttttactgacaaatagtactattggtatcattggtggtggacaacttggtcgtatgctagctcttgctgcgaaagcgatggggtatcgtattattgttctcgatcctaccgctgattgtccagctgctcaagtaagtgatgagcaaattattgctgactatgatgataaagtagcattacgcgaactttccgaaaaagcagatgtagttacatatgaatttgaaaatatcgactatgatgctttgaaaatgacgcaaaacttagtatctgtcccacaaggatcggaattgctttcgattacacaggataggattttggaaaaagcttatctggaatcagctaatattaacattgcgccatatgcggttatagtggaacaagatgaaatcgaaaatgaaattaaaagtattggatatcctgctgttttaaaaacggcacaaggtggatacgacgggaaaggccaagtggttattcatgatgcgagggatatcgaaacagcagcgagattattgcgttacggctcttgtgtactagaagcttggattccttttgaaaaagagatttctgtggttgtcgctcgtaatttagatgggcaaatagaaacttttccagttgcagaaaatgtacatgtaaataatattttgcatacgactatggttccagcagatgtggcggctgacgtttacgaggaagcggaagaaattgcgagaaagttagcagaagtacttcaattatgtggtgttttagcagtagaaatgtttgtgacaaaatcaggcgctatttatgtaaatgaacttgccccaagaccgcataactccggacattttacaattgaagcttgttcgatttctcagtttacgcagcatattcgagcgattgttggattaccactcgtaaaaccagaacttttaaaacccgccgtaatgattaatattttagggcaacatgttgatgctgtgaataaacaaatggtgaattatcctcattggtttgtacattattatggcaaaaaagaagcgaaaatcaatcgcaaaatgggacatgtcactgtgctggctgatgaaccaaaagcggttatacaagatttagaagaaacgcaaatttggaagtaa

SEQ ID NO: 13969 - protein, 377 aa, Listeria monocytogenes str. 1/2a F6854
MIILDKKFLLTNSTIGIIGGGQLGRMLALAAKAMGYRIIVLDPTADCPAAQVSDEQIIADYDDKVALRELSEKADVVTYEFENIDYDALKMTQNLVSVPQGSELLSITQDRILEKAYLESANINIAPYAVIVEQDEIENEIKSIGYPAVLKTAQGGYDGKGQVVIHDARDIETAARLLRYGSCVLEAWIPFEKEISVVVARNLDGQIETFPVAENVHVNNILHTTMVPADVAADVYEEAEEIARKLAEVLQLCGVLAVEMFVTKSGAIYVNELAPRPHNSGHFTIEACSISQFTQHIRAIVGLPLVKPELLKPAVMINILGQHVDAVNKQMVNYPHWFVHYYGKKEAKINRKMGHVTVLADEPKAVIQDLEETQIWK

SEQ ID NO: 13970 - DNA, 1086 bp, Bacillus cereus G9241
  CDS (1)..(1086): transl_table=11
atggcattggcagctaaggaaatgggatataaaattgctgttttagatcctacaaaaaactcaccatgtgcacaagttgctgatattgaaattgttgcatcatatgacgatttaaaagcaattcagcatttagccgagattagtgatgttgtcacatatgaatttgagaatattgattatagatgtttacaatggcttgaaaagcatgcttacttaccgcaaggcagtcagttgttaagtaaaacgcaaaatcgttttactgaaaagaatgcaattgaaaaagcgggattaccagtagcaacgtatagattggttcaaactcaagagcagcttactgaagcaatcactgagttatcatatccttccgtcttaaaaacaacgacaggtggatatgatgggaaagggcaagttgttttaagaagtgaagctgacattgatgaagcgcgaaagcttgcgaatgcagcagagtgtattttagagaaatgggtgccttttgaaaaagaagtatcagttatcgtaattcgtagtgtaagtggtgaaacgaaagtatttccggtagcggaaaatattcatgtaaataacattttacatgaatccatcgttccagctcgcattacagaagaactttctcaaaaagcaattgcttatgcacaagtgctcgcggatgaactagaacttgtgggaacactagcggtagagatgtttgctacagctgatggtgagatttacattaatgaattggcgccaagacctcacaattcaggacactatacacaggatgcatgtgaaacgagtcaattcggtcaacatattcgagcaatctgtaatttacctcttggagaaacaaatttgttaaaaccagttgtcatggtaaacattttaggcgaacatatagaaggggtcctaagacaagtgaatagattaaccgggtgctatttacacttgtatggaaaagaagaagcaaaagcgcagcgaaaaatggggcatgttaatattttaaatgataatattgaagtcgctctaggaaaagcgaagagtttgcatatttgggaccatcaagaacaactgttggagggaaaaagatga

SEQ ID NO: 13971 - protein, 361 aa, Bacillus cereus G9241
MALAAKEMGYKIAVLDPTKNSPCAQVADIEIVASYDDLKAIQHLAEISDVVTYEFENIDYRCLQWLEKHAYLPQGSQLLSKTQNRFTEKNAIEKAGLPVATYRLVQTQEQLTEAITELSYPSVLKTTTGGYDGKGQVVLRSEADIDEARKLANAAECILEKWVPFEKEVSVIVIRSVSGETKVFPVAENIHVNNILHESIVPARITEELSQKAIAYAQVLADELELVGTLAVEMFATADGEIYINELAPRPHNSGHYTQDACETSQFGQHIRAICNLPLGETNLLKPVVMVNILGEHIEGVLRQVNRLTGCYLHLYGKEEAKAQRKMGHVNILNDNIEVALGKAKSLHIWDHQEQLLEGKR

SEQ ID NO: 13972 - DNA, 999 bp, Wolbachia endosymbiont of Drosophila simulans
  CDS (1)..(999): transl_table=11
atgactgctatcgctgcaacaaaacttggacaaaaaacacatgtttttgccagtgctaaagacgatccggcttgctctgttgctgatgatttcacaatagcagatttctctgataagaaagctcttgaatcttttgcacagagtgtggatttagttactattgagtctgaaaatattccatgtagtgcaattgatatcgatgtaaatttttatccgggtaaaaaagcgttacacatttcgcagaacagactgagagaaatggattttattaaaaacttgggtataaaaactgctaactataagagtatacaaaattataatgagctactgaaaagcagtagagcttttggctatccaacaaggctgaaaacaacagaaatgggttatgatggaaaagggcaatatgtgcttgagaatgattctgaagtgaagcaatttgcttcctttgattggaatacagagtacattcttgaagcaagtgttgatttactgaaagaggtttcaatagtcgttgcaagagataaaaacggtaaagtagctttttttcctatagcaaaaaattaccacgttgatggaatacttgatacttcaacagtgccagctaaaatagatagtaaattaactcaagaggtacaacgagctgcaaagaaaatagcaaatgcgcttgatgtaataggaattctggctattgaattttttgttactaaggataacgaattgttagttaatgaactagctcccagacctcacaattcttgccactggagcttggatgcatgtaacgttagtcaatttgaacaactggttaggataatatgcgggctacctatgcaggaagtagtattacgctttccttgtatgacgaaaaatataataggtaatgatatatatgattctcataagtatttgagcaacgaaaaagctagtttaaccatatatgggaaaaaagaggttagggataagcgtaaaatgggacatgtcaatatagatttaagttaa

SEQ ID NO: 13973 - protein, 332 aa, Wolbachia endosymbiont of Drosophila simulans
MTAIAATKLGQKTHVFASAKDDPACSVADDFTIADFSDKKALESFAQSVDLVTIESENIPCSAIDIDVNFYPGKKALHISQNRLREMDFIKNLGIKTANYKSIQNYNELLKSSRAFGYPTRLKTTEMGYDGKGQYVLENDSEVKQFASFDWNTEYILEASVDLLKEVSIVVARDKNGKVAFFPIAKNYHVDGILDTSTVPAKIDSKLTQEVQRAAKKIANALDVIGILAIEFFVTKDNELLVNELAPRPHNSCHWSLDACNVSQFEQLVRIICGLPMQEVVLRFPCMTKNIIGNDIYDSHKYLSNEKASLTIYGKKEVRDKRKMGHVNIDLS

SEQ ID NO: 13974 - DNA, 1152 bp, Bacillus anthracis str. A2012
  CDS (1)..(1152): transl_table=11
  misc_feature (990)..(990): w is a or t
atgacgagaatcattttacctggaaaaacaatcggcattattggaggcggccagctaggaagaatgatggcattggcagctaaggaaatgggatataaaattgctgttttagatcctacaaaaaactcaccatgtgcacaagttgctgatattgaaattgttgcatcatatgacgatttaaaagcaattcagcatttagcagagatcagtgatgttgtcacatatgaatttgagaatattgattatagatgtttacaatggcttgaaaaacatgcttacttaccgcaaggcagtcagttgttaagtaaaacgcaaaatcgttttacagaaaaaaatgcaatagaaaaagcgggattaccagtagcaacgtatagattggttcaaaatcaagagcagcttactgaagcaatcgctgagttatcatatccttccgtcttaaaaacaacgacaggtggatatgatgggaaagggcaagttgttttaagaagtgaagctgacgttgatgaagcgcgaaagcttgcgaatgcagcagagtgtattttagagaaatgggtgccttttgaaaaagaagtatcagttatcgtaattcgtagtgtaagtggtgaaacgaaagtatttccggtagcggaaaatattcatgtaaataacattttgcatgaatccatcgttccagctcgcattacagaagaactttctcaaaaagcaattgcttatgcaaaagtgctagcggatgaactagaacttgtgggaacactagcggtagagatgtttgctacagccgatggtgagatttacattaatgaattggcgccaagacctcacaattcaggacactatacacaggatgcatgtgaaacgagtcaattcggtcaacatattcgagcaatctgtaatttacctcttggagaaacaaatttgttaaaaccagttgtcatggtaaacattttaggcgaacatatagaaggggtcctaagacaagtgaatagattwaccgggtgctatttacacttgtatggaaaagaagaagcaaaagcgcagcgaaaaatggggcatgttaatattttaaatgataatattgaagtcgctctagaaaaagcaaagagtttgcatatttgggaccatcaagaacaactgttggagggaaaaagatga

SEQ ID NO: 13975 - protein, 383 aa, Bacillus anthracis str. A2012
  misc_feature (330)..(330): The Xaa at location 330 stands for Leu, or Phe.
MTRIILPGKTIGIIGGGQLGRMMALAAKEMGYKIAVLDPTKNSPCAQVADIEIVASYDDLKAIQHLAEISDVVTYEFENIDYRCLQWLEKHAYLPQGSQLLSKTQNRFTEKNAIEKAGLPVATYRLVQNQEQLTEAIAELSYPSVLKTTTGGYDGKGQVVLRSEADVDEARKLANAAECILEKWVPFEKEVSVIVIRSVSGETKVFPVAENIHVNNILHESIVPARITEELSQKAIAYAKVLADELELVGTLAVEMFATADGEIYINELAPRPHNSGHYTQDACETSQFGQHIRAICNLPLGETNLLKPVVMVNILGEHIEGVLRQVNRXTGCYLHLYGKEEAKAQRKMGHVNILNDNIEVALEKAKSLHIWDHQEQLLEGKR

SEQ ID NO: 13976 - DNA, 1119 bp, Crocosphaera watsonii WH 8501
  CDS (1)..(1119): transl_table=11
atgagtaataagcgtgttggtgttattggtgggggtcaactggcctggatgatggctatggccaccgaaaaattaggggtgaacttattagtacaaacccctcactccgatgatccagcagtggcgatcgcagatgagtccatttttgcagctattgatgatgctgatgcaacgaaaaaattagccaaaaaatgcgatattattacttttgaaaacgaatttattaacttagatgctctcaaaaaattagaagcaagtggggtcatttttcgtcccaaattatcagctttatcccctttattagacaaatatgaacaaagaagttatttacaaagtattgatcttcctgtcccaaaatttacgaccctagaaaaattatcattgaatgattttaactttcctttagttattaaagcccgtcgtcatggttacgatggtcaaggaacttttattattgataacgaaaaagaattagaatctttatcatcatctgaaactaattctttaatggtagaggaatatatagagtttgaccgagagttagcgattatggctgcccgtagtacaacaggagaaattgttacttatcctctggtagaaacctatcaaaaagaccaagtttgtcattgggttattgctccggctaatgtttctgaaactgtagaattagaagcaaaaaaaatggctgagcatctattaacgaaattagaagtagtggggattttcggtattgaattatttttgacatcagaaggaacattgttagtcaatgaaattgctcccagaacccataactctggtcattataccctagatgcctgtgatatttctcagtttgaaatgcagttaagagcagtgataggtaaaccattaggaacaacaaaattaaatgctttaggagccgttatggtgaacttactaggatatgaaaatatccatgatgattatctagaaaaaagagataaaattgctcaatttcctgatacccatattcattggtacggtaaaacagaatgtcgccctggtcgaaaattaggtcatgttactgtattaattaaagatgataatatcaaccctgaaaacattgctaaaaaaatagaatcaatttggtataattga

SEQ ID NO: 13977 - protein, 372 aa, Crocosphaera watsonii WH 8501
MSNKRVGVIGGGQLAWMMAMATEKLGVNLLVQTPHSDDPAVAIADESIFAAIDDADATKKLAKKCDIITFENEFINLDALKKLEASGVIFRPKLSALSPLLDKYEQRSYLQSIDLPVPKFTTLEKLSLNDFNFPLVIKARRHGYDGQGTFIIDNEKELESLSSSETNSLMVEEYIEFDRELAIMAARSTTGEIVTYPLVETYQKDQVCHWVIAPANVSETVELEAKKMAEHLLTKLEVVGIFGIELFLTSEGTLLVNEIAPRTHNSGHYTLDACDISQFEMQLRAVIGKPLGTTKLNALGAVMVNLLGYENIHDDYLEKRDKIAQFPDTHIHWYGKTECRPGRKLGHVTVLIKDDNINPENIAKKIESIWYN

SEQ ID NO: 13978 - DNA, 1104 bp, Exiguobacterium sibiricum 255-15
  CDS (1)..(1104): transl_table=11
atgaaacgggttggtatcttaggtggaggtcaattaggtcggatgatggctttatctgcacgccaaatgggctattcgctcatcacacttgatccaactgaaaacgcaccgtgtgcgcaagtagcggatcaacagattcaagcaccgttcacggatgtcgaggccgcaaagcgacttgctgctgaatcagacgtcgtgacctatgagtttgagaatatctcacacgaagtagcggaagcaatcggttataaactgattcacgggacagagcttttgtttcggacccaacaccggattcgggagaaagaactgattgaacagcttggttacaaggtggcaccgtatcagggagttcagacaagtgaagatctccttggagccaaacggcagttaggtttcccattcgtcttgaaaacagcccgctttggttacgacgggaaaggccagacggtcattcggacagagctggatttacaaacagcgatgaagacctttgaagcaaccgaatatgttgctgaaaaatggttaccgtttgatcaggagatttccgtcatcgtcatgcgaagcgagcgggaaacgaaggtcttcccggtcagtgaaaatatccatcaagacaacattctgcatctgtcaatcgttcccgcccgcatcccaatcgacttggaacaaaaagcgattgaactggcgacacgtctcgcaaacgatgtcgatttgattggcacactggcaatcgaactgttcgtcgtcggctccgaactgatcgtcaacgaactggcgccgcgcccgcacaactcgggtcattattcgattgatgcgtgtgagacgtcacagttcgagcagcacatccgcgctatctgcggactgccgcttggcgacacccgcttgacgacaccggtcgtcatggcgaacatcctaggtcagcatatcacggcattagacgaggcattaccgatgttatcctcgcggacgaaagtccatttatacggaaaacaggacgcaaaacaggggcggaagatggggcatctgaacatcttggctgattcggtcgaagaagcgttagccgaagttgagcgcctgcagatatggaaggagacggttagatga

SEQ ID NO: 13979 - protein, 367 aa, Exiguobacterium sibiricum 255-15
MKRVGILGGGQLGRMMALSARQMGYSLITLDPTENAPCAQVADQQIQAPFTDVEAAKRLAAESDVVTYEFENISHEVAEAIGYKLIHGTELLFRTQHRIREKELIEQLGYKVAPYQGVQTSEDLLGAKRQLGFPFVLKTARFGYDGKGQTVIRTELDLQTAMKTFEATEYVAEKWLPFDQEISVIVMRSERETKVFPVSENIHQDNILHLSIVPARIPIDLEQKAIELATRLANDVDLIGTLAIELFVVGSELIVNELAPRPHNSGHYSIDACETSQFEQHIRAICGLPLGDTRLTTPVVMANILGQHITALDEALPMLSSRTKVHLYGKQDAKQGRKMGHLNILADSVEEALAEVERLQIWKETVR

SEQ ID NO: 13980 - DNA, 1254 bp, Kineococcus radiotolerans SRS30216
  CDS (1)..(1254): transl_table=11
gtgtcgaccctcgtccccccgacgccccagcccgaggtcccccgggccgaccccgcgccctacgcccgtcccggcgggttccccgtcgtcggcgtcgtcggcggcggccagctggcccggatgatgcagcccccggcgatcgcgctcggcctgcggctgcgggtcctcgccgaggggcccggcgccagcgccgcccaggtcatcacccccgcgccggtcggcgcggccgacgacctcgaggccctggtcgccttcgcctccgagtgcgacgcggtcaccttcgaccacgagcacgtgccccccgcggggctgcgcgccatggccgaggtcacctccgtgcagccgggcgcggacgccctcgtgcacgcccaggacaagatcgtcatgcgcgagcgcctcaccgcgctcggggtcccgtgcccgcgctgggcccgggtcggggaccgcgccgcggtcgaggccttcgccgccggcgccggctggccggtcgtgctgaagaccccgcgcggggggtacgacggcaagggcgtcctcgtcctggactccgccggggacccggcctggagcacggccgaggcgtggctggccgactgggccggacgcggcgggctgctggccgaggagcacgtcgccttcacccgcgagctcgccgccctcgtcgtgcgcagcccctccggccaggccgcggcgtggccggtggtcgagaccgtccagcgcggcggggtctgccacgaggtcaccgcccccgcccccggcctcgacgaggagctcggcgcgcacctgaccgacgtcgccctgcgcgtcgccggcggcctcggggtcaccggggtgctggccgtggaggtgttcgaggtgctccgcgacggccgcccgaccgtgctggtgaacgagctcgcgatgcgcccgcacaactccgggcactggaccatcgacggcgccgagaccagccagttcgagaaccacctgcgcgcggtgctggacctgccgctgggctcgacgcgcgcccgcgccccgtggacggtcatggtcaacgtcctgggaccgcgcgagatcgaggcccgccacgaggacctctaccgctcctacctgcacgtcatggcccacgacccgggcgtgaaggtgcacctgtacggcaaggagcagcgcccgggccgcaagctcggccacgtcaccgtccacggcgacgacctggaatccgtccgcgcgcgtgcccggcacgcggcggccttcatcgcgggggagatcgacgagtga

SEQ ID NO: 13981 - protein, 417 aa, Kineococcus radiotolerans SRS30216
MSTLVPPTPQPEVPRADPAPYARPGGFPVVGVVGGGQLARMMQPPAIALGLRLRVLAEGPGASAAQVITPAPVGAADDLEALVAFASECDAVTFDHEHVPPAGLRAMAEVTSVQPGADALVHAQDKIVMRERLTALGVPCPRWARVGDRAAVEAFAAGAGWPVVLKTPRGGYDGKGVLVLDSAGDPAWSTAEAWLADWAGRGGLLAEEHVAFTRELAALVVRSPSGQAAAWPVVETVQRGGVCHEVTAPAPGLDEELGAHLTDVALRVAGGLGVTGVLAVEVFEVLRDGRPTVLVNELAMRPHNSGHWTIDGAETSQFENHLRAVLDLPLGSTRARAPWTVMVNVLGPREIEARHEDLYRSYLHVMAHDPGVKVHLYGKEQRPGRKLGHVTVHGDDLESVRARARHAAAFIAGEIDE

SEQ ID NO: 13982 - DNA, 1185 bp, Xylella fastidiosa Ann-1
  CDS (1)..(1185): transl_table=11
atgaagaccctcggtattcttggcggtgggcaactggcccgtatgctggcgttggctgcacccccattgggcgtgcgggtgtgtacctttgatcaaactgttgacgcttgtgctgggcagatgacgccgctctgggttggttgttttgatgatgtggctgcgttgcgtgactttgtcacccgggtggatgtcatcactttcgactctgagaacctgccggttgctagtgtgcaagtactgaaagaacacgtcccggtgtatccgaatccagaggtgcttgcagtggcccaggacaggctgagtgaaaaaaccttgtttcgtgacttggggattccggtgcccgacttcgttgctgtcgacaatcgggctgctttggatgtggcaatcgtcaaggtggggacaccttgtatcctcaagacgcgtcggtttggttacgatggcaaaggccaattccgcatcaagacgttgactgatgcggatgcggcttgggccatgctcggtgagcaagccggaataaccgggttgattttggaagcctttgtgccattccagcgtgagatgagcatccttgctgtgcgcggttgtaacggtcagtttcgttcttggccgttgacagagaattggcatgttgctggcgttctttctgtcagtttggctccaatggccgttgatcccacgctgcaggctgcggctgaagcctatgcgcgtttattggctgagcgattggactatgtgggcgtgttcgcactagagctgttcgtccacgatggtcgattacttgccaacgagatggcaccacgcgtgcataactccggacattggacgattgaaggggccgaaacgtcccagtttgaaaatcacctgcgtgctgtatttgggttaccgctcggtagcactgcgatgcgtggttatgcctgcatggtcaattgcttaggtgtcatgcctgatcaacaggcattacttgccctgtcaggcctacattggcacgactatggcaagcagccacgccaagggcgcaaggtcggtcatgccacactacgtgcggatcaacctgcggatttaatggcttctctagagcaggtgggcgcagtacttggggatcaagagcgcgtggctgtggtgctggagcgtttgtccgaggaggtgtcacggagggatgccgttgcggcgtcttcttctgtctga

SEQ ID NO: 13983 - protein, 394 aa, Xylella fastidiosa Ann-1
MKTLGILGGGQLARMLALAAPPLGVRVCTFDQTVDACAGQMTPLWVGCFDDVAALRDFVTRVDVITFDSENLPVASVQVLKEHVPVYPNPEVLAVAQDRLSEKTLFRDLGIPVPDFVAVDNRAALDVAIVKVGTPCILKTRRFGYDGKGQFRIKTLTDADAAWAMLGEQAGITGLILEAFVPFQREMSILAVRGCNGQFRSWPLTENWHVAGVLSVSLAPMAVDPTLQAAAEAYARLLAERLDYVGVFALELFVHDGRLLANEMAPRVHNSGHWTIEGAETSQFENHLRAVFGLPLGSTAMRGYACMVNCLGVMPDQQALLALSGLHWHDYGKQPRQGRKVGHATLRADQPADLMASLEQVGAVLGDQERVAVVLERLSEEVSRRDAVAASSSV

SEQ ID NO: 13984 - DNA, 1185 bp, Xylella fastidiosa Ann-1
  CDS (1)..(1185): transl_table=11
atgaagaccctcggtattcttggcggtgggcaactggcccgtatgctggcgttggctgcacccccattgggcgtgcgggtgtgtacgtttgatcaaactgttgacgcttgtgctgggcagatgacgccgctctgggttggttgttttgatgatgtggctgcgttgcgtgactttgtcacccgggtggatgtcatcactttcgactctgagaacctgccggttgctagtgtgcaagtactgaaagaacacgtcccggtgtatccgaatccagaggtgctcgcagtggcccaggacaggctgagtgaaaaaaccttgtttcgtgatttggggattccggtgcccgacttcgttgctgtcgacaatcgggctgctttggatgtggcaatcgtcaaggtggggacaccttgtatcctcaagacgcgtcggtttggttacgatggcaaaggccaattccgcatcaagacgttgactgatgcggatgcggcttgggccatgctcggtgagcaagccggaataaccgggttgattttggaagcctttgtgccattccagcgtgagatgagcatccttgctgtgcgcggttgtaacggtcagtttcgttcttggccgttgacagagaattggcatgttgctggcgttctttctgtcagtttggctccaatggccgttgatcccacgctgcaggctgcggctgaagcctatgcgcgtttattggctgagcgattggactatgtgggcgtgttcgcactagagctgttcgtccacgatggtcgattacttgccaacgagatggcaccacgcgtgcataactccggacattggacgattgaaggggccgaaacgtcccagtttgaaaatcacctgcgtgctgtatttggcttaccgctcggtagcactgcgatgcgtggttatgcctgcatggtcaattgcttaggtgtcatgcctgatcaacaggcattactggccctgtcaggcctacattggcacgactatggcaagcagccacgccaagggcgcaaggtcggtcatgccacactacgtgcggatcaacctgcggatttaatggcttctctagagcagttgggtgcagtactgggggatcaagagcgcgtggctgtggtgctggagcgtttgtccgaggaggtgtcccggagggatgccgttgcggcgtcttcttctgtctga

SEQ ID NO: 13985 - protein, 394 aa, Xylella fastidiosa Ann-1
MKTLGILGGGQLARMLALAAPPLGVRVCTFDQTVDACAGQMTPLWVGCFDDVAALRDFVTRVDVITFDSENLPVASVQVLKEHVPVYPNPEVLAVAQDRLSEKTLFRDLGIPVPDFVAVDNRAALDVAIVKVGTPCILKTRRFGYDGKGQFRIKTLTDADAAWAMLGEQAGITGLILEAFVPFQREMSILAVRGCNGQFRSWPLTENWHVAGVLSVSLAPMAVDPTLQAAAEAYARLLAERLDYVGVFALELFVHDGRLLANEMAPRVHNSGHWTIEGAETSQFENHLRAVFGLPLGSTAMRGYACMVNCLGVMPDQQALLALSGLHWHDYGKQPRQGRKVGHATLRADQPADLMASLEQLGAVLGDQERVAVVLERLSEEVSRRDAVAASSSV

SEQ ID NO: 13986 - DNA, 1086 bp, Streptococcus suis 89/1591
  CDS (1)..(1086): transl_table=11
atgaactcaactaaaacaatcgggattattggtggcggtcaactgggtcagatgatggccatttctgctatttacatggggcacaaggtcatcacgctggatccagcagcggactgcccagcttccaaggttagcgaggttatcgtcgctccctatcacgatgtggcggccctcaaacagctggcggagcggtgcgatgtcctgacctacgagtttgaaaatgtcgatgccgacggactggacgcggtcatcaaggacggccagctccctcaggggacagacctcctccgtatttcccaaaactgcatttttgagaaggattttttggcaaaaaaagctggcgtgcaagtcgccccctacaaagtcgtcacatctagcctagacctagaaggtctggacctcagcaaaaactacgttttgaagacagctactgggggctatgatggacatggtcagaaggtcattcgagaagccgcggacttggaggcggctagtcagttagccaactctaccgagtgtgttttggaagagtttgtgaatttcgacctggaaatctccgtccttgtgtctggcaatggctccgactacaccgtctttcctgtgcaggaaaatatccaccgcaataatattctttacaagaccattgtgcctgctcgtatttctgatgaacttgctgaaaaagccaaaactatggccctgcaaatcgcagacaaactccatttggcaggcaccctctgtgttgagatgtttgtggcagggcaagaaattcttgtgaatgaaatcgctcctcgcccgcacaattcaggacattattcgattgaagcctgtgatttttcacagtttgacacccatatccgaggcattttaggggagcccctgccccctatccgcctgctttctccagctgttatgatcaatgtcctcggacaagacatggaagcagtccaaacctttcttcaagaaaaccctaccgctcatgcccacttttatggtaaactagaagcaaagcacaatcgcaaaatgggacacgtgacggtgttgacggaagacgttgaggtgggatttagacaagatgaaattagatag

SEQ ID NO: 13987 - protein, 361 aa, Streptococcus suis 89/1591
MNSTKTIGIIGGGQLGQMMAISAIYMGHKVITLDPAADCPASKVSEVIVAPYHDVAALKQLAERCDVLTYEFENVDADGLDAVIKDGQLPQGTDLLRISQNCIFEKDFLAKKAGVQVAPYKVVTSSLDLEGLDLSKNYVLKTATGGYDGHGQKVIREAADLEAASQLANSTECVLEEFVNFDLEISVLVSGNGSDYTVFPVQENIHRNNILYKTIVPARISDELAEKAKTMALQIADKLHLAGTLCVEMFVAGQEILVNEIAPRPHNSGHYSIEACDFSQFDTHIRGILGEPLPPIRLLSPAVMINVLGQDMEAVQTFLQENPTAHAHFYGKLEAKHNRKMGHVTVLTEDVEVGFRQDEIR

SEQ ID NO: 13988 - DNA, 1158 bp, Croceibacter atlanticus HTCC2559
  CDS (1)..(1158): transl_table=11
atgaacaactacttttcttcagattttactataggtattcttggcggaggccagctaggtaaaatgttattatacgaaacacgtaaatacgatattaggactcatgtactagatcctaatcctcaagctccttgtaaaatttcatgtaataaatttacagaaggtagtttaatggattatgacacagtttataactttggaaaacaagttgatgtcttaacttttgaaatagaagctgttaatgttgaagcgttagaagcattagaaaaagaaggaaaaacagtatatccttctgctcaaacacttagaaaaatacagaacaagggtgtacaaaaagagttttacgaatctaatggtatacctacagctcaatttaaacgctatgaaaccaaacaactcttaactgaagctatagttagaaaagaacatagttttccttttgtatggaaaagttgtgaaggcggttatgatggtaaaggtgtgagcgttattagagatgatgaagatcttataccgttacccgaggtttcttgtatagcagaggaaatgattccctttaaaaatgaacttgcagtaattgttgtaagaaatcctaaaggtgatgttaaaacatatcccgtagtggaaatggaatttcatcctgaagctaaccaagtagaatatgttatatgtcctgcaaggatagaaaaaactattgcagacaaagctagaactgtggctaaaaaagtctctgagtcttttgagcacgtgggtattttagctgtagagttattccagacacataacgatgagatactagtaaatgaagtagcgccaagaccacataactcaggtcattttagcatagaaggtagcttcacaaatcaatttgaacaacacttaagagctatcttaaatttaactttaggaagtacaaaaagtaaagttgggagtgttatggtaaaccttgttggtgaggaaggctatactggccaagtgtattacgaaaatattgagaacatcatgagtttaaatggtgtaacgccacatatatatggtaaacgtgaaacacgaccatttagaaaaatgggacacgttactattatagatgaggacataaatgaagcaagacgagttgctgaaaaagtaaaacaaaaaattaaagttatttctaaataa

SEQ ID NO: 13989 - protein, 385 aa, Croceibacter atlanticus HTCC2559
MNNYFSSDFTIGILGGGQLGKMLLYETRKYDIRTHVLDPNPQAPCKISCNKFTEGSLMDYDTVYNFGKQVDVLTFEIEAVNVEALEALEKEGKTVYPSAQTLRKIQNKGVQKEFYESNGIPTAQFKRYETKQLLTEAIVRKEHSFPFVWKSCEGGYDGKGVSVIRDDEDLIPLPEVSCIAEEMIPFKNELAVIVVRNPKGDVKTYPVVEMEFHPEANQVEYVICPARIEKTIADKARTVAKKVSESFEHVGILAVELFQTHNDEILVNEVAPRPHNSGHFSIEGSFTNQFEQHLRAILNLTLGSTKSKVGSVMVNLVGEEGYTGQVYYENIENIMSLNGVTPHIYGKRETRPFRKMGHVTIIDEDINEARRVAEKVKQKIKVISK

SEQ ID NO: 13990 - DNA, 1074 bp, Sulfitobacter sp. EE-36
  CDS (1)..(1074): transl_table=11
atgactgaagcattgaagacaggggccaccatcgggattttgggcggcgggcaactggggcgcatgctggccgttgctgccgcacgtctggggtttcgcacgcatatctttgaacccggtgccaacccgcctgcaggtgatgtcgcccatgcgctgaccaccgctggctatgatgacgtcgacgcgctgaccgcctttgccaaatcggttgatattgtcaccttcgagtttgaaaacatcccgacagatgcgctggatgtgatcgaaaacatcacccccatccgtcccaaccgcgaggcgctgcgcaccagtcaggaccgtctggtggagaaacagttcctcgaaggtttgggcctgactgtcgccccctttgccgatatcgccaatgccgccgatctggaggctgcgatgacgacgatcggcgcgccgtcgatcctgaaaacccgtcgcttcggctatgacggaaaggggcagtcgcgcctgcgcagcgcggatgatgcggcgggggccttggcagatatggctggcaatcctgcggtgctggaaggctttgtgaacttcaccgccgaagtgtccgtgatcgccgcgcgcagcccctcgggcgaggttgcctgtttcgatcccggtgagaatgtgcaccgcgacggcatcctgcacaccaccaccgtccctgcccggctcagcgccgcacagcgcatggatgcggtactgctggccgccaagatcctgaatgcgctggattatgtcggcgtgctgggggtcgagcttttcgtcacgccgcaaggtttcatcgtgaacgagatcgcgccacgggtgcataactcgggccattggacgcagaacggctgtgcggtggaccagttcgaacagcacatccgtgccgtggcgggatggcccttgggcgacggcagccgctatgcagatgtggtgatggagaacttgatcggcgacgatatggaccgcgtgcccgagctggcgaaacagcgcgacacagcgctgcatctctacggcaaggccgacatcaaaccgggtcgtaagatgggccatgtgaatatcgtcaaacggcccagctag

SEQ ID NO: 13991 - protein, 357 aa, Sulfitobacter sp. EE-36
MTEALKTGATIGILGGGQLGRMLAVAAARLGFRTHIFEPGANPPAGDVAHALTTAGYDDVDALTAFAKSVDIVTFEFENIPTDALDVIENITPIRPNREALRTSQDRLVEKQFLEGLGLTVAPFADIANAADLEAAMTTIGAPSILKTRRFGYDGKGQSRLRSADDAAGALADMAGNPAVLEGFVNFTAEVSVIAARSPSGEVACFDPGENVHRDGILHTTTVPARLSAAQRMDAVLLAAKILNALDYVGVLGVELFVTPQGFIVNEIAPRVHNSGHWTQNGCAVDQFEQHIRAVAGWPLGDGSRYADVVMENLIGDDMDRVPELAKQRDTALHLYGKADIKPGRKMGHVNIVKRPS

SEQ ID NO: 13992 - DNA, 1020 bp, Roseovarius nubinhibens ISM
  CDS (1)..(1020): transl_table=11
atgctctcggtcgcggcctcgcggctcggctttcgcacggtgatcttcgagccgggcgccgattgccccgcctcgcatgtggcggaccgccacattcaggccgcctattccgacgaggatgcgctgcgcgactttggccaatcggtcgatgtcatcacctatgagttcgagaacatcccgacatcggcgcttgacctgctcgaggatctggcccccgtgcgccccggccgcgaagccctgcgggtgagccaggaccggatgaccgagaaggaatttctctcaggcctcggcctcaccaccgcgccgttcgctgccgtggatgatgccgcgagccttgcccgcgcgctcgaccagatcggcacgccctcgatcctcaagacccgccgtttcggctatgacggcaagggccaggcccggctgcgcagcccagaggatgccgaaaccgcgcttgccgatatggccggtgcgccctcggtgctcgaagggttcgtcgaattcagccatgaggtctcggtcatcgcggcgcggggcaccgatggctcggtcgcctgtttcgaccccggcgagaatgtccacaaggacggcattctcagcaccaccaccctgcccgcgcggctcagcaccgcgcagcgcaccgatgcggtgctgctcgccggtcgcatcctcaacgcgctcgactatgtcggcgtgatgggggtcgagcttttcgtgacggccaagggcctcgtggtgaacgagattgcgccccgggtgcataactcgggccattggacgcagcagggctgtagcgtcgaccagttcgaacagcatattcgcgccgtggcgggctggcccttgggcgacggcgggcgctatgcggatgtggtgatggagaacctcatcggcgaggacatggaccgcgtgcccgatctggcccgcgatcctgccgtttcgctgcatctctatggcaaggccgaggtcaagccgggccgcaagatgggccatgccaaccgggtgatcggccccgcctcgcgcggctag

SEQ ID NO: 13993 - protein, 339 aa, Roseovarius nubinhibens ISM
MLSVAASRLGFRTVIFEPGADCPASHVADRHIQAAYSDEDALRDFGQSVDVITYEFENIPTSALDLLEDLAPVRPGREALRVSQDRMTEKEFLSGLGLTTAPFAAVDDAASLARALDQIGTPSILKTRRFGYDGKGQARLRSPEDAETALADMAGAPSVLEGFVEFSHEVSVIAARGTDGSVACFDPGENVHKDGILSTTTLPARLSTAQRTDAVLLAGRILNALDYVGVMGVELFVTAKGLVVNEIAPRVHNSGHWTQQGCSVDQFEQHIRAVAGWPLGDGGRYADVVMENLIGEDMDRVPDLARDPAVSLHLYGKAEVKPGRKMGHANRVIGPASRG

SEQ ID NO: 13994 - DNA, 1068 bp, Oceanicola batsensis HTCC2597
  CDS (1)..(1068): transl_table=11
atgactgatcccctttcccccggttccaccatcggcatcctcggcggcggtcagctgggccgcatgctctcggtcgcggcggcgcgcctcgggatgaagacctgcgtcttcgaaccgggcggcgactgccccgccgcgcatgtggccaactatcacctgcgcgccgactacaccgacgaagccgccctgcgccgctttgccgacagtgtcgacgtcatcacctatgagttcgagaacatccccacctcggccctcgacctgctggagccgctgaaacccatccgtcccggccgcgaggcgcttcgcgtctcgcaggaccgtctgacggaaaaggattttctcaccgggctcggcctgcaaacagccccctatgccgatatactcacggcagagtccctgacgcaggcgatcgaggagatcggcacacccgccatcctcaagacccgccgcttcggctatgacggcaagggtcaggcgcggatcatgtcgcccgacgaagcctcggccgcgctggccacgctcgagggcgccccggcgatcctcgagggttttgtcgagttcacctcggaaatctcgatcatcgccgcccgcggcctcgacgggtccgtcgcctgctacgatcccggagagaacgtccaccgcgagggcattttgcgcaccacgaccgttcccgcgacgttgccggccccggcccgcaccgacgccgtgctgctggcggcgaagatcctgaacgcgctggattatgtcggtgtgatgggggtggagcttttcgtcacccccgccggcctcgtggtcaacgagatcgccccccgcgtccacaattccggccactggacccagaacggctgtgtcgtggaccagttcgaacagcatatccgcgccgtggcgggctggcccttgggggacggctcgcgtcatgcggacgtggtgatggagaacctgatcggcgcggatgtcgagcgggtcgccgatctggcgagcgagacgggggtggcggtgcatctctacggcaaggccgagatcaaggccgggcggaagatggggcacatctgccgggtcgcaagctga

SEQ ID NO: 13995 - protein, 355 aa, Oceanicola batsensis HTCC2597
MTDPLSPGSTIGILGGGQLGRMLSVAAARLGMKTCVFEPGGDCPAAHVANYHLRADYTDEAALRRFADSVDVITYEFENIPTSALDLLEPLKPIRPGREALRVSQDRLTEKDFLTGLGLQTAPYADILTAESLTQAIEEIGTPAILKTRRFGYDGKGQARIMSPDEASAALATLEGAPAILEGFVEFTSEISIIAARGLDGSVACYDPGENVHREGILRTTTVPATLPAPARTDAVLLAAKILNALDYVGVMGVELFVTPAGLVVNEIAPRVHNSGHWTQNGCVVDQFEQHIRAVAGWPLGDGSRHADVVMENLIGADVERVADLASETGVAVHLYGKAEIKAGRKMGHICRVAS

SEQ ID NO: 13996 - DNA, 1200 bp, Prochlorococcus marinus str. MIT 9211
  CDS (1)..(1200): transl_table=11
atgagaaatgaatcattaacaagaaataacaaagtaggcccaacagttggtgtcgttggtggaggacaacttgcgcagatgttggctaaagctgccagagagagagggattgatttaattgttcagactggattgaggagtgaccctgccgttcaatatgctaagggattagtactttcggatacaagcgatattaatggaacaaaagaacttgcaagcaaatgtagctgcttgacctttgagaatgaatggattgatgtaacgtctctctcttcgctggctaacgatagctccttatttcagcctagcttaaattcaattaagccattagtagacaaactttctcaaagaaagcttttaaacgatttgaatatccctggtccagaatggctgcccctagcatgtattaaaaaaaaggatttagagcttccagacggttgggcatatccagtaatggcaaaggcaggtaaaggaggatatgacggtaaaggaacaagagttataaatgatgccaatgaacttaaggagctgtttttctctgttgatgtttctaattggttcttagagaaatggattagctatcaaaaagagttggcaattgttgtcagtcgagatacctgtggacgaataaactcttatcccttaacagagactttccaacataagcaagtctgtgattgggttgttgcacctgcgaatgtaagtcattcagtccttgtcacggcttataacgtaggtgcttcgttattgagagagctaaattatgtaggtgtacttgcgattgaattcttttatggggatgagggattgctcgtcaatgaaatagccccacgtactcacaactctgctcattttacaattgacgcatgcagtagtagtcaatttgaccaacaaatatgcatagctgccggtctaccagcccctccggttaaattagtcgtaccaggcgcaatcatgatcaatttgttaggcttgcgaggcaaagcaaattccttagatgaacgattggagaagttaaagcaaataaatggcgcaaaacttcattggtattctaaagataaagtcttgcctggaagaaaattaggtcatttaacagttcccttactcgatttagaccccacttcaagaattaataaggcgacaagcattttaaaaaaagtaagagcaatctggcccttttttgttcccgatatcaattag

SEQ ID NO: 13997 - protein, 399 aa, Prochlorococcus marinus str. MIT 9211
MRNESLTRNNKVGPTVGVVGGGQLAQMLAKAARERGIDLIVQTGLRSDPAVQYAKGLVLSDTSDINGTKELASKCSCLTFENEWIDVTSLSSLANDSSLFQPSLNSIKPLVDKLSQRKLLNDLNIPGPEWLPLACIKKKDLELPDGWAYPVMAKAGKGGYDGKGTRVINDANELKELFFSVDVSNWFLEKWISYQKELAIVVSRDTCGRINSYPLTETFQHKQVCDWVVAPANVSHSVLVTAYNVGASLLRELNYVGVLAIEFFYGDEGLLVNEIAPRTHNSAHFTIDACSSSQFDQQICIAAGLPAPPVKLVVPGAIMINLLGLRGKANSLDERLEKLKQINGAKLHWYSKDKVLPGRKLGHLTVPLLDLDPTSRINKATSILKKVRAIWPFFVPDIN

SEQ ID NO: 13998 - DNA, 1071 bp, Erythrobacter sp. NAP1
  CDS (1)..(1071): transl_table=11
atgaaagtcgcaacccccggatcgacaattggtatccttggcggaggccagcttggccggatgctgacgatggcggcaagccagctaggctatcgctgcatcggatatgcgccagcaggcgacaatgtttcagccgacctgtgcgcagactttttcgagaacggctggggcgacaccgctgcgctcgcagcgtttgccacccagtgcgatgtggtgacatgggagttcgagaacgtccctctcaccgcagtgaatgcaatgccggcagatcgcctcgcacccggcgcaaagtcgcttcaagtggcgcaggaccgcttggccgaaaagcgcttcgtcgaagagcttggcgcgacgtgtgcgccttacatgcgtgtcgaaagcgacgaggatttccgccgcgctctggatcggatcggaacgcccggcatcctcaagaccgcgcgcgaaggctatgacggcaagggccagtggcgcattgcctctgcgcatgaagccgaaggcgtgcgctttcccggtcgcccctgcgtgtatgagggcatggtcgatttcgatgccgagttttccgtcattctcgtgcgcgggcatgacggcgaggtgcgtatctgggattcgaccgccaacacgcacgaaggcggcatgctggtgcgctcgaccctgcccgccggcccatcggtcgaggcacaggtcgagatcgcccgcgatattgcacgccagactgccgacgctctgcaatatgtcggcgttttgacgcttgagttcttcgcaaccaagcaaggcccggtcttcaacgagatggctccgcgcgtgcacaactcaggtcactggaccattgaaggcgcagcgacgagccagttcgaaaaccacatccgcgccatttgcggccttcccctgggcgctaccgaaacccgcttcgccagcatcgatatgcgcaacatcgtgggagaggatgcgcaatccgcccatcagatcttggcagaagatggcgagccgcacctgcacctctacggcaagcgcgaagcgcgtgagggccgcaagatggggcatgtcacgcgggtcagccacaagacataa

SEQ ID NO: 13999 - protein, 356 aa, Erythrobacter sp. NAP1
MKVATPGSTIGILGGGQLGRMLTMAASQLGYRCIGYAPAGDNVSADLCADFFENGWGDTAALAAFATQCDVVTWEFENVPLTAVNAMPADRLAPGAKSLQVAQDRLAEKRFVEELGATCAPYMRVESDEDFRRALDRIGTPGILKTAREGYDGKGQWRIASAHEAEGVRFPGRPCVYEGMVDFDAEFSVILVRGHDGEVRIWDSTANTHEGGMLVRSTLPAGPSVEAQVEIARDIARQTADALQYVGVLTLEFFATKQGPVFNEMAPRVHNSGHWTIEGAATSQFENHIRAICGLPLGATETRFASIDMRNIVGEDAQSAHQILAEDGEPHLHLYGKREAREGRKMGHVTRVSHKT

SEQ ID NO: 14000 - DNA, 1185 bp, Synechococcus sp. RS9917
  CDS (1)..(1185): transl_table=11
atgaccaccaccccgagggagctggccaccgacaccatcggagtgatcgggggcgggcagctggcccagatgctcgctgaagcggcgcgccagcgcggtgtggccctggcggtgcagtgcagctcccgggaggatccggcggcggcgtgggcgagtcggctcgtcgaggcgaaccccctcgatgccgtcgccagccgggagctggtgcccggttgcctgggcgtgacgttcgagaatgaatggattgatctcgacgcgctcatgccgctggagcgccagggtgtgcgcttccggcccacgttggcgagcctgaaacctctgatcgacaagctggagcagcgtcaattgctcgatgacctggcgatccccggtccggcctgggtgccactccggtcgatcgaccccggcgcaccttctctgccgaagggctgggtgtttcccgtgatggcgaaggcggcccgcgggggctacgacggcaagggcacgcgcattctccagtcgatcgaagatctggcccagctgctccggaccgtggatcccggcgcctggctgctcgaatcctgggttgcctatgagcgggaactggcgttggtggtgagtcgtgacggcaagggaagggttcgcagcctgcccctcgtggagacccaccagaaccagcaggtgtgcgactgggtgttggcgccagctccggtggagcagttggtggaggccacggcctacaacatggccgcatccctgctcaccaagctcaactatgtgggggtgatggccctggagttgttctatggcccccaggggctgctggtgaacgagatcgcaccgcgcacccacaactccggtcatttttcgattgaagcctgcagcagcagccagttcgaccagcagctctgcatcacggccggactgccggtccctgatcccgacctgctctgtcagggggcgctgatggtgaatctgctcggcctggatgccgatcaggcgacgcctctggagcagcgactccaggctctgaaggccgacccgcgctttcacctgcattggtatggcaaggctgaggagagccctggccgcaagctcgggcatgtcacggtgcttctggagcagacggatggtgaagggcggtttcacgaagcgcgggaactgcggggcgcgatccgagcgatctggcctctgcccttagattga

SEQ ID NO: 14001 - protein, 394 aa, Synechococcus sp. RS9917
MTTTPRELATDTIGVIGGGQLAQMLAEAARQRGVALAVQCSSREDPAAAWASRLVEANPLDAVASRELVPGCLGVTFENEWIDLDALMPLERQGVRFRPTLASLKPLIDKLEQRQLLDDLAIPGPAWVPLRSIDPGAPSLPKGWVFPVMAKAARGGYDGKGTRILQSIEDLAQLLRTVDPGAWLLESWVAYERELALVVSRDGKGRVRSLPLVETHQNQQVCDWVLAPAPVEQLVEATAYNMAASLLTKLNYVGVMALELFYGPQGLLVNEIAPRTHNSGHFSIEACSSSQFDQQLCITAGLPVPDPDLLCQGALMVNLLGLDADQATPLEQRLQALKADPRFHLHWYGKAEESPGRKLGHVTVLLEQTDGEGRFHEARELRGAIRAIWPLPLD

SEQ ID NO: 14002 - DNA, 1251 bp, Synechococcus sp. WH 5701
  CDS (1)..(1251): transl_table=11
atgggcggcagtatcggcgtggtggggggcggccaactggcctggatgcttgccgcggccgccaggaagcagggtgtggagctgcatgttcagactccggagctctccgatcccgccgcacggctggccaccagcgtggtgcgggcgccgttggccgatctggcggcctcccgtcgtctggccgagagggcgtcggcgatcagtttcgagaacgaatggcttgaccttgcggcccttgcggcgctggagcaggagggcgtggtcttcatcccccggctggagtccctggcggatctggtctgcaagcgccgtcagcgccagctgctggagcggttgcacctcccctcgccgcgctggttcccgttggagcagctgctgactccgccggcggcggccgagctggaggatgcgccgttggccggggccgaggagcctgccggcgaagcggctgagccagagctgcccctgccgccccagcttccgcaggggtttgacttcccgttgatggccaaggcggtacggggggggtacgacggccgcggcacccgggtgatccgcagccaggcggaactggaggccctgatcgaggcggtggatcccagcctgtggctgctggaggagttcgtggctttcgagcaggagctggcgctggtggcctgccgcgatcacctcggggcggttcagtgctaccccctggtggagacgcaccagcatgatcaggtctgcgactgggtgcttgcaccagctgccgccagccaggcggtggaggcccgcgcccgcaacgtggcggcctcgctgctggcagccctcgattacgtcggtgtgctctcgatcgagtttttctacggacgcacgggcctcctgatcaacgagctcgccccgcgcacgcacaactccggccactacacgatcgaagcgtgtcgcaccagccagttcgcccagcaggtgcgcatcgtctcgggacagcccctcggggacaactccatgacgctgagcggcgcgttgatggtgaacctgctgggtttcgagacctccacggcggcctacgccaggcaacgccaggccctggagacccttccagccgcccacctgcactggtatggcaaacgtctggcccggcccgggcgcaagctgggtcacatcaccctggagctcaaggcctcaggtgcggctgagcgggccagggaggcagccctgaggctggctgaggtccgggcaatctggccactgccaccagcccgtaccccttag

SEQ ID NO: 14003 - protein, 416 aa, Synechococcus sp. WH 5701
MGGSIGVVGGGQLAWMLAAAARKQGVELHVQTPELSDPAARLATSVVRAPLADLAASRRLAERASAISFENEWLDLAALAALEQEGVVFIPRLESLADLVCKRRQRQLLERLHLPSPRWFPLEQLLTPPAAAELEDAPLAGAEEPAGEAAEPELPLPPQLPQGFDFPLMAKAVRGGYDGRGTRVIRSQAELEALIEAVDPSLWLLEEFVAFEQELALVACRDHLGAVQCYPLVETHQHDQVCDWVLAPAAASQAVEARARNVAASLLAALDYVGVLSIEFFYGRTGLLINELAPRTHNSGHYTIEACRTSQFAQQVRIVSGQPLGDNSMTLSGALMVNLLGFETSTAAYARQRQALETLPAAHLHWYGKRLARPGRKLGHITLELKASGAAERAREAALRLAEVRAIWPLPPARTP

SEQ ID NO: 14004 - DNA, 1179 bp, Synechococcus sp. WH 7805
  CDS (1)..(1179): transl_table=11
atgggcagcgctgacggcgcaatcggtgtgattgggggcgggcagctggcccgcatgctgtcggaggcggcttctctccgcggcattgatgtgttggttcaaacctcgtccgaggacgattgcgccgttgctgcatccagccgattggtgaaggctttgccgaccgaccaggacgccacccgagaactggctcgcgattgcagtggcatcaccttcgagaatgaatgggtgtcggtggacgccctgatgcctctggaacgtcagggtgtcagctttgttccttcgctggccagcttggttcccctcgtcaacaaactctcccagcgccgacttctcgacgatctctccattcccagccctcgatggatctgtctggctgagatcaacccaggctcgccagctctgcctcctggctggaacttccccgtcatggccaaggctgcgtccggtgggtacgacggaaagggcacgcaaatcattggcaatctcaatgatctggcccatctcatgcgcaatgtccgagcacaggactggttgctcgaggcatgggtccgctttgaacgggagctggctctcgtagtcagtcgcgatcgacatggtcgtatccgccatctgccaatggtggaaacccaacagaagaatcagatctgtgactgggttctcgcccctgccgaagcggaacccctgctggaagcaaccgcttacaacatcgcggcctccctgctgacgcgcctgggatatgtgggtgtgatggctctggaatttttctacggaccggaaggtttgttcgtgaacgaaatcgctccgcgcacccataactccggtcatttttccatcgaagcctgttccagcagtcagttcgatcagcagctctgcatcacggcagggctacccgttccttcaacagagctcgtggtggagggcgcttttatggtcaaccttcttggcttgccagaagctgaggcaggtgatggccactcagacctcaacgaacgtcttggcaagcttcgtgcgatacccaatgcccacgtgcattggtatggaaagcaggaactgcctggccgcaaagtgggtcacgtcaccgttgtgctgcatgagcacaacgcagggtcccgtcgccagacagcgatgaccatcctccgccaaatccgagaagtgtggccgaatcctctaaattga

SEQ ID NO: 14005 - protein, 392 aa, Synechococcus sp. WH 7805
MGSADGAIGVIGGGQLARMLSEAASLRGIDVLVQTSSEDDCAVAASSRLVKALPTDQDATRELARDCSGITFENEWVSVDALMPLERQGVSFVPSLASLVPLVNKLSQRRLLDDLSIPSPRWICLAEINPGSPALPPGWNFPVMAKAASGGYDGKGTQIIGNLNDLAHLMRNVRAQDWLLEAWVRFERELALVVSRDRHGRIRHLPMVETQQKNQICDWVLAPAEAEPLLEATAYNIAASLLTRLGYVGVMALEFFYGPEGLFVNEIAPRTHNSGHFSIEACSSSQFDQQLCITAGLPVPSTELVVEGAFMVNLLGLPEAEAGDGHSDLNERLGKLRAIPNAHVHWYGKQELPGRKVGHVTVVLHEHNAGSRRQTAMTILRQIREVWPNPLN

SEQ ID NO: 14006 - DNA, 1149 bp, Pseudoalteromonas tunicata D2
  CDS (1)..(1149): transl_table=11
atgaacatattagtattaggtgcgggtcaacttgcacgcatgatgagtttagaaggcgccccccttgatttaaatgtgcgcgcttatgatgttggaacaaaaaccattgttcatccgctcactctcacaacttttacgcaaactcttgaacagtgtattgcgtttgttgatgtgatcacggctgaatttgaacacattcctgatgatgtcttagcactttgctgcgcgagcggtaagttttatcccggcaaagctgcaataaaagcaggtggcgatcgcaatatcgaaaaagccttacttgataaagccagtgtcccttctgcgccatatcagttaattactgaaaaagcgcattttgtggctgctgccgagtcactcggtttacctctagtgattaaaacgtgccaagcaggctatgatggcaaaggtcaatggcgcttaaaatcattaaaccaacttgatgagatttggctggaaatggctgaatttttagctcgcggtactgcggattttccgcatactattattgctgaaaaaatgatcccctttgatcgtgaggtctcggtaattggtgcgcgaaataaacaaggtgagtttgcaatttaccctgttactgaaaatcaacatactaatggtgtactcacactttcattagccggttttgttgatgcagcagtgcaaaatcaagccattgatgcgtttaaaaaactcaccaatgaaatggattatgtcggtgttatggcgattgagttttttgatgttgcgggccagttaatggttaatgaaattgcgccacgtgttcataattcaggtcattggacgcagcaagggacagcatgtagccaatttgagaaccatcttcgtgctgttgcgggcttaccgttaggtgatacgcaattacaaaagccaagtgtaatgattaatgtgctgggtcaggctcaaatcaactctgaggttttacgcattgcagatgtgaaaagccattggtatggtaaaagccaaaaacctggtcgtaaaatgggtcatattaatgtatcagcaacgagcgctaatgaacttgctaacaagcttgaacgtttagctgctatattgcctgatgaagattaccctggggttaaagcaactgctgagcgcttgctaaatcagtaa

SEQ ID NO: 14007 - protein, 382 aa, Pseudoalteromonas tunicata D2
MNILVLGAGQLARMMSLEGAPLDLNVRAYDVGTKTIVHPLTLTTFTQTLEQCIAFVDVITAEFEHIPDDVLALCCASGKFYPGKAAIKAGGDRNIEKALLDKASVPSAPYQLITEKAHFVAAAESLGLPLVIKTCQAGYDGKGQWRLKSLNQLDEIWLEMAEFLARGTADFPHTIIAEKMIPFDREVSVIGARNKQGEFAIYPVTENQHTNGVLTLSLAGFVDAAVQNQAIDAFKKLTNEMDYVGVMAIEFFDVAGQLMVNEIAPRVHNSGHWTQQGTACSQFENHLRAVAGLPLGDTQLQKPSVMINVLGQAQINSEVLRIADVKSHWYGKSQKPGRKMGHINVSATSANELANKLERLAAILPDEDYPGVKATAERLLNQ

SEQ ID NO: 14008 - DNA, 1119 bp, Photobacterium sp. SKA34
  CDS (1)..(1119): transl_table=11
atgaataatgtgctagtccttggtgctggccaacttgcccgtatgatggcactggctggcgctcctcttaacatcaatgtgctcgcttatgatgtagagagtgataaagtggttcatcctcttacccaacaagcaatgtcgaactcgctcgttgaagcgattaatgacgttgatgcgatcactgccgagtttgaacatattcctcacgatattttagatatttgtgctgccagcgagaagttcttcccaacgccagaagcaatcaaagccggtggcgatcgtcgtctagaaaaagcgttattggatcatgctggcgtgcgcaatgctaaataccatgaaatcactgaacgtgcagatcttcttactgcaattgaaaaaatcgggttaccgctggttttaaaaagtgcattaggtggctacgacggtaaagggcagtggcgcttaaaagaaagcgtacagattgatgatatttggcctgaaatggcgcaatgtattgctgattctcctaatcagactattgttgctgagcaatttattccttttcaacgcgaagtatcattgattggtgcccgtaatcgccgtggtgatattcaggtatttaacttaactgaaaatgtccatactgatggcgtactgagtttatcaactgcgattgtgggtgactcaccactgcaagcgcaagcagataacatgttccgtgccatcgctaatagccttgattatgtcggcgtgttagctatcgaatttttcgatctcgatggcgaactactggtaaacgaaatcgcgccgcgggttcataattcaggccactggacacagcaaggtgcagaaacatgtcagttcgagaaccacttacgtgccgtttgtgattttccacttggcagcactcaaataactcgtcctagtgcgatgatcaatatcttaggtttagatagcgttcctgatgcggtttatgcccaagaaggttgccatatacactggtacggtaaagaaaaacgagcgggacgtaaaatgggtcacatcaacgtgtgtgcagatacaccagagcaattgcagtatcgtttgatcatgttatcaagctttctggatgagaaggatttccccgcactgcctcgttaa

SEQ ID NO: 14009 - protein, 372 aa, Photobacterium sp. SKA34
MNNVLVLGAGQLARMMALAGAPLNINVLAYDVESDKVVHPLTQQAMSNSLVEAINDVDAITAEFEHIPHDILDICAASEKFFPTPEAIKAGGDRRLEKALLDHAGVRNAKYHEITERADLLTAIEKIGLPLVLKSALGGYDGKGQWRLKESVQIDDIWPEMAQCIADSPNQTIVAEQFIPFQREVSLIGARNRRGDIQVFNLTENVHTDGVLSLSTAIVGDSPLQAQADNMFRAIANSLDYVGVLAIEFFDLDGELLVNEIAPRVHNSGHWTQQGAETCQFENHLRAVCDFPLGSTQITRPSAMINILGLDSVPDAVYAQEGCHIHWYGKEKRAGRKMGHINVCADTPEQLQYRLIMLSSFLDEKDFPALPR

SEQ ID NO: 14010 - DNA, 1101 bp, Oceanospirillum sp. MED92
  CDS (1)..(1101): transl_table=11
atgcacgttgctattgttggctgtggtcagctagcccgaatgatggcattagctgggtggcctatgggtcaccactttaccttccttgccgatccgggcgagagttttatctgtgttgaaggtctcggccgcgtcgtcgaactggaaaccgatctggaaggcgaagccctctacgaagctttaggtaaacctgacgttgtcacggttgaacgtgagcacgttaatgttgcccgactcaatacgctgaaacctcattgctccgttttccctgacccggaagcgatcaagtactgtcagcaccgcggccgtgagaaaaccttcctaaactcactaggcattcagactgcgcctttccacctggcgaataatgctgaagagctatcctccggcgtcaaagcacttggcttcccggtatttgttaaaacctgcgaagaaggttacgacggatatggtcagtgggttctgaaatgcgaagaagatctgaacaacctggtcgctgaagccgacagcctgccagaagtagtcattgaaggtcgtgttaattttgaccgtgaactatcgctgatcgcagcacgtaacgcctcaggcgattgtgttttctatccactaacagaaaaccttcaccgcaacggtattctgtggagttcgattgccccagctgatgcaccagctgcactgcacgctaaagcaaaagatatcgcagataagattcttaatgcgatggaatatgttggcgtaatcgccattgagatgttccacgcaggtgatgatcttatcgtgaatgaactggcaccgcgtgtccacaacagtggccactggactcagggcgcaggtattagctctcagttcgagaaccatattcgtgcaatctgcgattacggtttgggtatcacaacatgcaatcagcatgcaggtatggttaacctgttaggtatcgaagcacctaagtcgattgttagcgagagcaatgtacaacaccatgtgtataacaagtctcttcgtccagggcgtaaagtaggccacctgaatctggttagcgacgaccgcgcagcgctcgaagctcagcttgaacgaattcgcgaaagcctctattcagactaa

SEQ ID NO: 14011 - protein, 366 aa, Oceanospirillum sp. MED92
MHVAIVGCGQLARMMALAGWPMGHHFTFLADPGESFICVEGLGRVVELETDLEGEALYEALGKPDVVTVEREHVNVARLNTLKPHCSVFPDPEAIKYCQHRGREKTFLNSLGIQTAPFHLANNAEELSSGVKALGFPVFVKTCEEGYDGYGQWVLKCEEDLNNLVAEADSLPEVVIEGRVNFDRELSLIAARNASGDCVFYPLTENLHRNGILWSSIAPADAPAALHAKAKDIADKILNAMEYVGVIAIEMFHAGDDLIVNELAPRVHNSGHWTQGAGISSQFENHIRAICDYGLGITTCNQHAGMVNLLGIEAPKSIVSESNVQHHVYNKSLRPGRKVGHLNLVSDDRAALEAQLERIRESLYSD

SEQ ID NO: 14012 - DNA, 1146 bp, Flavobacteria bacterium BBFL7
  CDS (1)..(1146): transl_table=11
atgagcacaccacttttttcttcaccgtttacgcttgggattctgggcggcggacaactaggtaaaatgatgttatacaccacgcgtaaatgggatatcgccacttatgtgatggataaagatgatacagcacctgcttttgaaggttgtactgtcttttttgaaggagatattatggactatcaggccgtgatggagtttggcgaacaagtcgatgtgttaactattgaaatagaaaacgtcaacgtgcaagcacttcaggatttagaagataaaggtatcgcggtttctcctagtgctcgtgtattgaacttaattagaaataaagcggttcaaaaacaattttatctagataataatatcccgacagctccatttcaaattcatgctgcaccagaattaaatcacggtaaaacatatccattcatatggaaaagtgctgaaggtggctatgatggtaaaggtgtaaaagtaatccgtcaagaaagcgaccttaacgacttgcctcaggtggaatgtatctatgaagatatgatcgattttgagctggaactggctgtaatagtctctcgtaatgctagtggagatatgaaaacttatcctgtggtagagatggaatttcacccagaagctaatcaggtagaatatgtaatatgtccagcacgtatagatgacgccgtttctgaaaaagctcgtgctattgctctagaagtaagttctgcttatgaccatgtaggcctactagctgtagaaatgttcttaactaaaaatggagacattctagtaaatgaagtggcacctagaccacataattctggtcattattctatagaaggttctgtcacagatcagtttgaacaacacgtgcgttgtgtacttgacttacctttaggaaatacagatagtactgttgctgctgtcatggtcaacttagtaggtgaagaaggtcatacaggaaatgttatctatgatggtatagaagatattctagccatgcctggtgtgacaccacacatttatggtaaaaaacaaaccagaccttttagaaaaatgggtcatgttactgtggtagataaagatgtcgctgtcgcacgtgaaattgctgcacaggttaaagatcgaattaaggttgttgctgaggattga

SEQ ID NO: 14013 - protein, 381 aa, Flavobacteria bacterium BBFL7
MSTPLFSSPFTLGILGGGQLGKMMLYTTRKWDIATYVMDKDDTAPAFEGCTVFFEGDIMDYQAVMEFGEQVDVLTIEIENVNVQALQDLEDKGIAVSPSARVLNLIRNKAVQKQFYLDNNIPTAPFQIHAAPELNHGKTYPFIWKSAEGGYDGKGVKVIRQESDLNDLPQVECIYEDMIDFELELAVIVSRNASGDMKTYPVVEMEFHPEANQVEYVICPARIDDAVSEKARAIALEVSSAYDHVGLLAVEMFLTKNGDILVNEVAPRPHNSGHYSIEGSVTDQFEQHVRCVLDLPLGNTDSTVAAVMVNLVGEEGHTGNVIYDGIEDILAMPGVTPHIYGKKQTRPFRKMGHVTVVDKDVAVAREIAAQVKDRIKVVAED

SEQ ID NO: 14014 - DNA, 1089 bp, delta proteobacterium MLMS-1
  CDS (1)..(1089): transl_table=11
atgagggtaggtatcctgggtgccggccagttggggcggatgctggccctggccggctaccccctggggctgcaatttgtcctgctggatcccaacccccgggcctgcggtggccagttggcgcccctggtggtggccgatttcgccgatgaagcggccttggcggatttagccgagcaggcggaggtggtcacctttgaatttgaaaatgtgccggtggcggccctgaacctgttggccgcccagcggccggtctttcccggcccggagattctggaggtggcccaggatcggcgccgggaaaaggagtgtttccaacaactggcgatccctactccggcctaccggctggtcgacgatccggccgggctggcggcggcggtggccgccatcggcctgccggcggtgctcaaaacccggcggctgggctacgacggcaaagggcaggtggtgttgcggcggcaggacgagctggcggcggcctgggcggccctgggcggttccccgctgatcctggaggcctttgtgccctttgagcgggaggtttcgctggtggcggtgcggggccgcgatggcgccacggccttttatcccctcaccgaaaacacccatcgtgatggtatcctgcggctttcccgggtgctggtggatgatcccctgcaggcccgggcggcagactatgcgagccggctgctggcgcgttttgattatgtcggggtgctggcctttgaattcttcgtgttaaatgacgacctggtggccaacgagattgccccccgggtgcataattccggccactggaccatcgatggggcggtgaccagccagtttgagaatcatctgcgggccatcatgggttggccattgggttccaccgccgccaccggcccggcggcgatgctcaacttcatcggcgagttgcccgccagcgccgagttgctggcccatcccgggctccatttgcatgcctatggtaaagagccggcccccggccgcaaggttgggcatgccaacctttgtctgccaccggggaccgatctgcaagccgccctggcagggttgcggcgggccggcctggagtgggattga

SEQ ID NO: 14015 - protein, 362 aa, delta proteobacterium MLMS-1
MRVGILGAGQLGRMLALAGYPLGLQFVLLDPNPRACGGQLAPLVVADFADEAALADLAEQAEVVTFEFENVPVAALNLLAAQRPVFPGPEILEVAQDRRREKECFQQLAIPTPAYRLVDDPAGLAAAVAAIGLPAVLKTRRLGYDGKGQVVLRRQDELAAAWAALGGSPLILEAFVPFEREVSLVAVRGRDGATAFYPLTENTHRDGILRLSRVLVDDPLQARAADYASRLLARFDYVGVLAFEFFVLNDDLVANEIAPRVHNSGHWTIDGAVTSQFENHLRAIMGWPLGSTAATGPAAMLNFIGELPASAELLAHPGLHLHAYGKEPAPGRKVGHANLCLPPGTDLQAALAGLRRAGLEWD

SEQ ID NO: 14016 - DNA, 1089 bp, delta proteobacterium MLMS-1
  CDS (1)..(1089): transl_table=11
atgagggtaggtatcctgggtgccggccagttggggcggatgctggccctggccggataccccctggggctgcaatttgtcctgctggatcccaacccccgggcctgcggtggccagttggcgcccctggtggtggccgatttcgccgatgaagcggccctggcggatttagccgagcaggcggaggtggtcacctttgaatttgaaaatgtgccggtggcggccctgaacctgttggccgcccggcggccggttttccccggcccggagattctggaggtggcccaggatcggcgccgggaaaaggagtgtttccaacaactggcgatccctactccggcctaccggctggtcgacgatccggccgggctggcggcggcggtggccgccatcggcctgccggcggtgctcaaaacccggcggctgggctacgacggcaaagggcaggtggtgctgcggcggcaggacgagttggcggcggcctgggcggccctgggcggttccccgctgatcctggaggcctttgtgccctttgagcgggaggtttcgctggtggcggtgcggggccgcgatggcgccacggccttttatcccctcaccgaaaacacccatcgtgatggtatcctgcggctttcccgggtgctggtggatgatcccctgcaggcccgggcggcagactatgcgagccggctgctggcgcgttttgattatgtcggggtgctggcctttgaattcttcgtgttaaatgacgacctggtggccaacgagattgccccccgggtgcataattccggccactggaccatcgatggggcggtgaccagccagtttgagaaccatctgcgggccatcatgggttggccattgggttccaccgccgccaccggcccggcggcgatgctcaacttcatcggcgagttgcccgccagcgccgagttgctggcccaccccgggctccatttgcatgcctatggtaaagagccggcccccggccgcaaggttgggcatgccaacctttgtctgccaccggggaccgatctgcaagccgccctggcagggttgcggcgggccggcctggagtgggattga

SEQ ID NO: 14017 - protein, 362 aa, delta proteobacterium MLMS-1
MRVGILGAGQLGRMLALAGYPLGLQFVLLDPNPRACGGQLAPLVVADFADEAALADLAEQAEVVTFEFENVPVAALNLLAARRPVFPGPEILEVAQDRRREKECFQQLAIPTPAYRLVDDPAGLAAAVAAIGLPAVLKTRRLGYDGKGQVVLRRQDELAAAWAALGGSPLILEAFVPFEREVSLVAVRGRDGATAFYPLTENTHRDGILRLSRVLVDDPLQARAADYASRLLARFDYVGVLAFEFFVLNDDLVANEIAPRVHNSGHWTIDGAVTSQFENHLRAIMGWPLGSTAATGPAAMLNFIGELPASAELLAHPGLHLHAYGKEPAPGRKVGHANLCLPPGTDLQAALAGLRRAGLEWD

SEQ ID NO: 14018 - DNA, 1089 bp, delta proteobacterium MLMS-1
  CDS (1)..(1089): transl_table=11
atgagggtaggtatcctgggtgccggccagttggggcggatgctggccctggccggataccccctggggctacaatttgtcctgctggatcccaacccccgggcctgcggtggccagttggcgcccctggtggtggccgatttcgccgatgaagcggccctggcggatttagccgagcaggcggaggtggtcacctttgaatttgaaaatgtgccggtggcggccctgaacctgttggccgcccggcggccggttttccccggcccggagattctggaggtggcccaggatcggcgctgggaaaaggagtgtttccagcaactggcgatccccactccggcccaccggctggtcgatgatccggccgggctggcggcggcggtggccgccatcggcctgccggcggtgctcaaaacccggcggctgggctacgacggcaaaggacaggtggtgctgcggcggcaggacgagttggcggcggcctgggcggccctgggcggttccccgctgatcctggaggcctttgtgccctttgagcgggaggtttcgctggtggcggtgcggggccgcgatggcgccacggccttttatcccctcaccgaaaacacccatcgtgatggtatcctgcggctttcccgggtgctggtggatgatcccctgcaggcccgggcggcagactatgcgagccggctgctggcgcgttttgattatgtcggggtgctggcctttgaattcttcgtgttaaatgacgatctggtggccaacgagattgctccccgggtgcataattccggccactggaccatcgatggggcggtgaccagccagtttgagaatcatctgcgggccatcatgggttggccattgggttccactgccgccaccggcccggcggcgatgctcaacttcatcggcgagttgcccgccagcgccgagttgctggcccatcccgggctccatttgcatgcctatggtaaagaaccggcccccggccgcaaggttgggcatgccaacctttgtctgccaccggggaccgatctgcaagccgccctggcagggttgcggcgggccggcctggagtgggattga

SEQ ID NO: 14019 - protein, 362 aa, delta proteobacterium MLMS-1
MRVGILGAGQLGRMLALAGYPLGLQFVLLDPNPRACGGQLAPLVVADFADEAALADLAEQAEVVTFEFENVPVAALNLLAARRPVFPGPEILEVAQDRRWEKECFQQLAIPTPAHRLVDDPAGLAAAVAAIGLPAVLKTRRLGYDGKGQVVLRRQDELAAAWAALGGSPLILEAFVPFEREVSLVAVRGRDGATAFYPLTENTHRDGILRLSRVLVDDPLQARAADYASRLLARFDYVGVLAFEFFVLNDDLVANEIAPRVHNSGHWTIDGAVTSQFENHLRAIMGWPLGSTAATGPAAMLNFIGELPASAELLAHPGLHLHAYGKEPAPGRKVGHANLCLPPGTDLQAALAGLRRAGLEWD

SEQ ID NO: 14020 - DNA, 1107 bp, Oceanobacter sp. RED65
  CDS (1)..(1107): transl_table=11
atgagcattaagcgtgttggagttattggttctggccagcttggcaggatgatggccctagcgggaacaccattgaatgtagagttcgtattctatgacgaagcaacgctttcgcctagttcacgcctaggcgacaccataaagccaagtgaaccagacgggctgaatcgattcattcaaagtgttgatgttgtaacgtacgaatcggaaaatacagacgtcagccttgtggaacatatctctcgattaaagccgatttatcctggcacagaatcgctacgcaagagtcagcaccgtcttacagaaaaacaagcatttcggtctttaggcatagaaacagccccattttgcgcagttcgctcataccaagaagcgctagacgcagcttctcagcttggctatccatttatcttgaagaccacgacagaaggctacgacggcaagggtcaagcactggtgaaaaccagtagcgacctgagtgaagcttgggagcaacttggcgataaagagttaatcgctgaggggtttgtaagattcacgcgcgaactgagcattattgcggtgagagatgcaaaaggaaataccaagacttacccgctagcggaaaatgagcaccgcgatggtattcttcgcgtttcgcgcgttcctgcgcagaatgtttctttagaaaagcagaaacaagctgagcgctacgcaaccgaaatgctcgatcatctcggtcatgtcggcgtattaacaattgagctattcgacacagaaaatggcttagtggcaaatgaaatggcaccgcgagtgcacaactccggccactggtccatcgaaggcgcatactgtagtcaatttgagaaccatgttcgcgccatctgtgatctaccacttggatctactgaagcttgccacccattctctgccatgatcaacgtcattggtcgccacggcaatggaaaccaggttctagaaacgcccaatcaatttttacactattacagtaaaagtgagcgtgctcatcgcaagattggccacatcaatacaatagcatcgtctattgcagaacttgaagaaagtatctccagtctacaatcgtttatcgaggaatccggagaataa

SEQ ID NO: 14021 - protein, 368 aa, Oceanobacter sp. RED65
MSIKRVGVIGSGQLGRMMALAGTPLNVEFVFYDEATLSPSSRLGDTIKPSEPDGLNRFIQSVDVVTYESENTDVSLVEHISRLKPIYPGTESLRKSQHRLTEKQAFRSLGIETAPFCAVRSYQEALDAASQLGYPFILKTTTEGYDGKGQALVKTSSDLSEAWEQLGDKELIAEGFVRFTRELSIIAVRDAKGNTKTYPLAENEHRDGILRVSRVPAQNVSLEKQKQAERYATEMLDHLGHVGVLTIELFDTENGLVANEMAPRVHNSGHWSIEGAYCSQFENHVRAICDLPLGSTEACHPFSAMINVIGRHGNGNQVLETPNQFLHYYSKSERAHRKIGHINTIASSIAELEESISSLQSFIEESGE

SEQ ID NO: 14022 - DNA, 1179 bp, Synechococcus sp. RS9916
  CDS (1)..(1179): transl_table=11
atgaccagccccaccgctgagaacggcagcccacgcattggagtggtgggtggcggtcagctggcccggatgttggtggaagctgcacgcgagcggggtctggcagtgattgttcagagtgcgtcgtcctcggaccccgcagcccaactggccgatgagctggtgcaagcggaccctgtcgatgctcaggccacgcaggcgtttctcggacggtgtggtgggatcacctttgaaaatgagtgggtcaacatcgatgcgctgtcggcgctggaacgcaaaggggcaccctttcgcccatcactttccagcctccagcccctggtcaacaagctgcatcagcgtcttttgctggatgagctgtccattccaagcccggcttgggtggagctgaaagagattgatcctggaaccccggccttacccaagggatggtcatttccggtgatggccaaggctgcgaccggtggatatgacggcaaaggcacgcaggtggtccgttccgttgatggtttggccgagctgcttcgctcggtggatcctgagaattggctgcttgaggcctgggtggactacgagaaggagctggcgctcgtggtgagccgcgaccagtccggaagggtacgggccatgcccctcgtggagacccagcaatcggatcaggtgtgcgattgggtcctggctccggcagcagtggagcaattggtggaagccaccgcttacaacgttgcggcttccttgctcaccaagctcgattacgtgggggttctcgcgatcgaaatgttttatggatccaaaggcctgttggtgaacgaaatcgcaccgcgcacccataattccggccatttttcgattgaggcctgcaaaagcagtcagtttgatcagcagctctgcatcgcagctggtttgcaggtgcccgatccggagctgaaggtgcccggtgctctcatggtgaatctgcttggcttagcggttgaccaggcagcaccgcttgagcagcgattggcagccctccaggccgatccttccctgcacttgcactggtatggcaagcagggtgagagtgaggggcgaaagctgggtcatgtcacggtgctgctgtcagccactgatgcagagactcgaagaaacgaggcgatggaagccttgaacaaggtgcgctcgatctggcccctgccctaa

SEQ ID NO: 14023 - protein, 392 aa, Synechococcus sp. RS9916
MTSPTAENGSPRIGVVGGGQLARMLVEAARERGLAVIVQSASSSDPAAQLADELVQADPVDAQATQAFLGRCGGITFENEWVNIDALSALERKGAPFRPSLSSLQPLVNKLHQRLLLDELSIPSPAWVELKEIDPGTPALPKGWSFPVMAKAATGGYDGKGTQVVRSVDGLAELLRSVDPENWLLEAWVDYEKELALVVSRDQSGRVRAMPLVETQQSDQVCDWVLAPAAVEQLVEATAYNVAASLLTKLDYVGVLAIEMFYGSKGLLVNEIAPRTHNSGHFSIEACKSSQFDQQLCIAAGLQVPDPELKVPGALMVNLLGLAVDQAAPLEQRLAALQADPSLHLHWYGKQGESEGRKLGHVTVLLSATDAETRRNEAMEALNKVRSIWPLP

SEQ ID NO: 14024 - DNA, 1128 bp, Vibrio sp. Ex25
  CDS (1)..(1128): transl_table=11
atgcatgtactggttcttggtgcgggtcaattggctcgaatgatgtctctggctggtgcgccactgaacatccaaatctcggcttacgatgtcggcagcggtaacgttgtccatcctcttacccaacaggtgcttggtcatggtttggaaaatgccattgaacaagtggatgcgatcaccgcagaattcgaacatattcctcacgatgtactcgacatctgtgaatcaagtggcaagctcctccctagtaccgcagccatcaaagcaggcggtgaccgccgtgttgaaaaagcgctactcgataatgctggcgtgcgtaatgccaagtactacgtgattgagacacgtgaagattttgaacgcgcaattgaacatgttggcatgcctatggtgctgaaaagtgcattgggtggttacgatggtaaaggccaatggcgcttgaaagaaacggctcagatcgagacgatctgggcagaaatgacggagtgcattgcagcaacaccaactcaagccattgtggctgaggagtttgttccttttaaccgcgaaatatcacttgtaggtgctcgcggtaaagatggcagcgttgaagtgtaccctctagcagaaaacgttcacatcaatggcgtactgagcttatccaccgcaattgatgcgccagaacttcaagcgcaagccaagcagatgttcaccgctgtagctgacagcctgaattatgttggcgtactggcattagagttctttgatgtcgatggcacactgttagtgaatgagattgccccacgcgtgcacaactctggtcactggacacagcaaggtgcagaaacgtgtcagttcgagaaccacctgcgcgccgtatgcggcttgccgttaggcagcaccaaactgattcgcgaaacctcgatggtgaatattcttggtgaagatacgttgccagaagcgcttctcgccatggatggttgtcacatccattggtacggcaaagagaagcgtgaagggcgaaaaatgggtcacatcaacgtatgtggtgactacccaggagaattacaccgtaggttgtgcgctctcgcggatgtcttagatccaatggcattcccagccgtgcacgagtttgcgaaacaagcataa

SEQ ID NO: 14025 - protein, 375 aa, Vibrio sp. Ex25
MHVLVLGAGQLARMMSLAGAPLNIQISAYDVGSGNVVHPLTQQVLGHGLENAIEQVDAITAEFEHIPHDVLDICESSGKLLPSTAAIKAGGDRRVEKALLDNAGVRNAKYYVIETREDFERAIEHVGMPMVLKSALGGYDGKGQWRLKETAQIETIWAEMTECIAATPTQAIVAEEFVPFNREISLVGARGKDGSVEVYPLAENVHINGVLSLSTAIDAPELQAQAKQMFTAVADSLNYVGVLALEFFDVDGTLLVNEIAPRVHNSGHWTQQGAETCQFENHLRAVCGLPLGSTKLIRETSMVNILGEDTLPEALLAMDGCHIHWYGKEKREGRKMGHINVCGDYPGELHRRLCALADVLDPMAFPAVHEFAKQA

SEQ ID NO: 14026 - DNA, 1149 bp, Alteromonadales bacterium TW-7
  CDS (1)..(1149): transl_table=11
atgaatattttaattttaggtgccggacaacttgcacgtatgatgagccttgcaggcgcaccgcttaatttgaatgtagttgcctacgatgtgggaactaaacaaattaagcacccgctaacgggtgagatttacacaactacacttgaacaagctattagcgacgctgattcaatcacggcagaatttgagcacattcctgatgatgtattaacgctatgctgcaacagtaataagttttatccgggtaaagccgcgattaaaacgggtggcgatagagcactagaaaaagcgttacttaacaaaaccggtgttgaatgcgcgccttatcagttaattacagaaaaagtacatttggagttggccgctaaaaacctgggtaagccacttgttataaaaacctgccaagcagggtacgatggtaaagggcagtggcgtttaaaatctgatgatcaaattgatgaaatttggtctgaaatggctgattttatagcatcgggaacacaagatgcaccgcataccattattgctgaaaaaatgatcccgtttgatcgagaagtgtcgattattggcgcaagagataagcacggtaatgttgcaatttatccattaacagaaaacgagcacaccaacggtgtgttaacactgtcggttgcgggtaaaaataaccaaaatgttgaagctcaagcaaacgatgcatttacaaaaattgcaaacgaacttaactatgtaggtgtattggccattgagttttttgatgtaatgggcacactattagttaatgaaattgcaccgcgtgtacataactcaggtcattggactcagcaaggttgccattgttcgcaatttgaaaaccatatgcgtgccgttgcaggtttaccacttggtaatactgagcttaaacatattacggctatgatcaatgtactcggacaagcaagtatccctgctgaggtacttacattatctgatgtgacaagtcattggtacggtaaaacggcgaagccaggtcgtaaaatgggtcatataaatgtatcggctcataatatgaatgacctgtcagataagttaagccaattaactgattatttaccagaacacgattacccgggaattttaaaaacggcagaaaagctcattctaggttag

SEQ ID NO: 14027 - protein, 382 aa, Alteromonadales bacterium TW-7
MNILILGAGQLARMMSLAGAPLNLNVVAYDVGTKQIKHPLTGEIYTTTLEQAISDADSITAEFEHIPDDVLTLCCNSNKFYPGKAAIKTGGDRALEKALLNKTGVECAPYQLITEKVHLELAAKNLGKPLVIKTCQAGYDGKGQWRLKSDDQIDEIWSEMADFIASGTQDAPHTIIAEKMIPFDREVSIIGARDKHGNVAIYPLTENEHTNGVLTLSVAGKNNQNVEAQANDAFTKIANELNYVGVLAIEFFDVMGTLLVNEIAPRVHNSGHWTQQGCHCSQFENHMRAVAGLPLGNTELKHITAMINVLGQASIPAEVLTLSDVTSHWYGKTAKPGRKMGHINVSAHNMNDLSDKLSQLTDYLPEHDYPGILKTAEKLILG

SEQ ID NO: 14028 - DNA, 1083 bp, Pseudomonas putida GB-1
  CDS (1)..(1083): transl_table=11
atgaagatcggtgtaatcggtggcggccagctgggccgcatgctggccctggcgggcaccccgctgggcatgaacttcgccttcctcgacccggcgccggacgcttgcgccgcgcccctgggcgagcacctgcgtgccgactacggcgaccaggaccacctgcgccagttggccgacgaagtcgacctggtcaccttcgagttcgaaagcgtcccggccgagaccgtggccttcctctcgcagttcgtgccggtgtaccccagcgccgaagcgctgcgcatcgcccgtgaccgcctgttcgaaaagagcatgttccgcgacctgggcattcccaccccggccttcgccgacatcctctcgcaggcagacctggaggcggcggtggccagcatcggcctgccagccgtactgaaaacccgcaccctgggttacgacggcaagggccagaaggtgctgcgcacgccagaagacgtggtcggtaccttcgccgagctgggcagcgtgccatgcctgctggaaggcttcgtgccgttcactggcgaggtgtcgctggtggctgtacgtgcccgcgatggcgaaacccgcttctacccgctggtgcacaatacgcacgaaagcggcatcctgcgcctgtcggtggccagccaggcacacccgctgcaggccctggccgaagactacgtcggccgtgtgttgcagaagctggattacgttggcgtgatggccttcgagttcttcgaggtagacggcggcctgaaggccaacgaaatcgccccgcgcgtgcacaactccgggcactggaccatcgaaggcgccgagtgcagccagttcgagaaccacctgcgcgccgttgccggcctgccgctgggctcgaccgccaaggtgggcgagagcgcgatgctcaacttcatcggtgaagtgccggccgtggacaaagtcgtcgccatcgccgactgccacctgcaccactatggcaaggccttcaaggttggccgcaaggttggccatgccacgctgcgctgccatgacatggccacccttgaacgcaagattgccgaagtagaggcactgatcagcaactga

SEQ ID NO: 14029 - protein, 360 aa, Pseudomonas putida GB-1
MKIGVIGGGQLGRMLALAGTPLGMNFAFLDPAPDACAAPLGEHLRADYGDQDHLRQLADEVDLVTFEFESVPAETVAFLSQFVPVYPSAEALRIARDRLFEKSMFRDLGIPTPAFADILSQADLEAAVASIGLPAVLKTRTLGYDGKGQKVLRTPEDVVGTFAELGSVPCLLEGFVPFTGEVSLVAVRARDGETRFYPLVHNTHESGILRLSVASQAHPLQALAEDYVGRVLQKLDYVGVMAFEFFEVDGGLKANEIAPRVHNSGHWTIEGAECSQFENHLRAVAGLPLGSTAKVGESAMLNFIGEVPAVDKVVAIADCHLHHYGKAFKVGRKVGHATLRCHDMATLERKIAEVEALISN

SEQ ID NO: 14030 - DNA, 1119 bp, Marinobacter sp. ELB17
  CDS (1)..(1119): transl_table=11
atgagaattggcgtactaggcgccggccaactgggaagaatgctcgccctggcaggttacccactggccaaagactttgtattctacgacatgtcaggcagccccagtgccggcataggcgaaaccatcagcgaccctaaaggccaaaggctggacgagtttctgagcaaggttgaccgcgtaacttacgaatttgaacacctaccggtagaagtcgccgaaaagattgcagcgaaaaccaccgtgcacccctgcccccgcgcattgcggatatgccagaaccgcgaagccgaaaaaacactgtttggccagctgggcattcctacaccgcaatggaaaatcgcagacagcgccgaaacgctgcgggccgccgctgaagagctcggctgcccggtagtcgccaagtccaacaccgaaggttacgacggcaaaggccaggcagtattgaaaagctcggaagacgccgccgctgcctggcagagcatcggccacccacgcctgatggtcgaaaagttcgtcgacttcagccgcgaactgtcgattattgccgtgcgcgccgaatgcggcgatgtggcgttttaccccatggcggataatgaccatcatcagggcattctgcgctactccgttgccccggcgccaaaattacaaccccacctgcaaagcgaagcagaagactatattcgcggcttactgaccgaattggactacgtgggcgtattaacacttgagctgtttgaaacaccaaacggcctggtagccaatgaaatggctccgcgagtgcacaactccgggcactggaccatagaaggcgccatgaccagccagttcgaaaatcatgtacgtgccgtcagcggacacgctctgggtaatgtggagccacggggggtcagctgcatgatcaacattattggcgagcacggcgaaatcgaacggattttacaactgccctacgcccatgttcacctgtacaacaagcaggagcgacctggccgcaaattgggccacgtgaatattctggccgacagttaccaggagctggtatggcgggttctaaattgcgctcaatttttgcccggttgcccggaatttaacagctccttaatttcaaagggttga

SEQ ID NO: 14031 - protein, 372 aa, Marinobacter sp. ELB17
MRIGVLGAGQLGRMLALAGYPLAKDFVFYDMSGSPSAGIGETISDPKGQRLDEFLSKVDRVTYEFEHLPVEVAEKIAAKTTVHPCPRALRICQNREAEKTLFGQLGIPTPQWKIADSAETLRAAAEELGCPVVAKSNTEGYDGKGQAVLKSSEDAAAAWQSIGHPRLMVEKFVDFSRELSIIAVRAECGDVAFYPMADNDHHQGILRYSVAPAPKLQPHLQSEAEDYIRGLLTELDYVGVLTLELFETPNGLVANEMAPRVHNSGHWTIEGAMTSQFENHVRAVSGHALGNVEPRGVSCMINIIGEHGEIERILQLPYAHVHLYNKQERPGRKLGHVNILADSYQELVWRVLNCAQFLPGCPEFNSSLISKG

SEQ ID NO: 14032 - DNA, 1155 bp, Bacillus sp. SG-1
  CDS (1)..(1155): transl_table=11
atgagcttgaataaaaaagtgatctatccaggacagactatcggcattatcggcggaggccagcttggcagaatgatggcactggccgcgaaggaagcaggcttcagaatcgcagttttggacccgggaagcaatggaccgtgtgctcaggttgccgatgaagtgatcattgcggattacgaagaccgtgaagcacttgaaaggctttcagaacttagcgacgtcattacatatgagtttgaaaacattgactaccatgcattgaaagatcttaccgaaaaggcatatgtcccgcagggtgcggaattgattcgtatcacgcaaaaccgcattgcggagaaggaagcccttgtatacggcggggtggaagtcgctccttatgaagtcattgtatgtgaagaggagatcggtgagaaagcagagaagcttggctatccggtcgtcctaaagacagccaggggcggctatgatggcaaaggccaggctgtactctatgaatctgcagatattgaaaaagccgcggggctcctggttggcggaccttgcgtacttgagaaatggatgtcttttgataaagaaatatctgtcattgttacaaggacaccatccggggaaatgagcgttttcccggcagtggagaacatccacgtggacaatattcttcatcagacgattgcgccggcaagaataagcgatgctgacaatgagaaggctgttaatacagcgaaaaaggtggcagaaacacttgatatggtcggcacgctggctgttgaaatgttcctgacggaagacaaggacatctatgtgaatgaattggctccgcgtcctcataactcaggacacttttccatcgaggcatgcgagacgtcacagtttgcccagcatatccgcgcgatttgtaactggccgttaaaaagtacggatatcatcaagccggctgtcatggtcaacatattgggagagcacctgcagggggttattgaaagcatccctcatcagccggcctggtccatccacctttatggaaaagatgaagcaaaggcgaagcgcaaaatggggcacgtgaccattttgacgaacgatatagagacggttttacttcaattaaatgagacagacatctggaacagtaaagaaatgatcggaggaaaataa

SEQ ID NO: 14033 - protein, 384 aa, Bacillus sp. SG-1
MSLNKKVIYPGQTIGIIGGGQLGRMMALAAKEAGFRIAVLDPGSNGPCAQVADEVIIADYEDREALERLSELSDVITYEFENIDYHALKDLTEKAYVPQGAELIRITQNRIAEKEALVYGGVEVAPYEVIVCEEEIGEKAEKLGYPVVLKTARGGYDGKGQAVLYESADIEKAAGLLVGGPCVLEKWMSFDKEISVIVTRTPSGEMSVFPAVENIHVDNILHQTIAPARISDADNEKAVNTAKKVAETLDMVGTLAVEMFLTEDKDIYVNELAPRPHNSGHFSIEACETSQFAQHIRAICNWPLKSTDIIKPAVMVNILGEHLQGVIESIPHQPAWSIHLYGKDEAKAKRKMGHVTILTNDIETVLLQLNETDIWNSKEMIGGK

SEQ ID NO: 14034 - DNA, 1176 bp, unidentified eubacterium SCB49
  CDS (1)..(1176): transl_table=11
atggcaaattacttttcttcaaattttactttaggaatattaggcggcggccaactaggtaaaatgatgggttatgaaacccgcaaatttgatattaaaacgcacgtattagaccctagtgcagaagcacctttccgtataagttgtgaccattttgagcaaggcgacttgatggattatgatacggtttataacttcggaaaaaaagtagacgtacttacttttgagatagaaggcgtaaacgttgaagcattagcagcacttgaaaaagaaggggttaaagtctatccttcttctgaaactttaaaaaacattcaggataaaggggtgcaaaaaaacttttacaaaaaacataatatccctacggctccgttttctgtttttgacaacaaaacagcgcttgttaatgctattgattcaaaagaaataacactcccttttgtatggaaaagttgtacgggcggttatgacggtacgggtgtttcggtaattagaaaccaaaaagacattgattctttaaacgacaggccgtgtattgcagagcagttaattccttttaaaaacgaactcgctgtaatcgtggttcgcaatccgtctggcgatgtaaaaacgtatcctgtagttgaaatggaatttcacccagaggccaaccaagtagaatatgttatttgtcctgcgagaataaatgacgaggtagcaacaaaagcacgagaaatcgccgttaaagtttcggaagcatttaaacatgtaggcttacttgcggtagaaatgttcctaacagatcccgatagttatacaggagacgaaattattgtgaatgaagtagctcctagacctcacaacagcggacattatagtattgaggcgagttacacaaaccagtttgagcaacaagtaagagccattctagacctacctttaggaaatacagatagtaaagtaggaggaatcatggtaaaccttgttggtgcagaggggcatacaggcgatgtggtttataaaaatattgaaaaaatcatggcgatggatggtgtaacaccacacatttatggaaaaaaacaaacccgtcctttcaggaaaatgggacatgtgactatcgtaaatgaagatattgacaaagcaagagcggttgcacaaaaagtaaaggaattaattaaagtagtcgcaacagaatag

SEQ ID NO: 14035 - protein, 391 aa, unidentified eubacterium SCB49
MANYFSSNFTLGILGGGQLGKMMGYETRKFDIKTHVLDPSAEAPFRISCDHFEQGDLMDYDTVYNFGKKVDVLTFEIEGVNVEALAALEKEGVKVYPSSETLKNIQDKGVQKNFYKKHNIPTAPFSVFDNKTALVNAIDSKEITLPFVWKSCTGGYDGTGVSVIRNQKDIDSLNDRPCIAEQLIPFKNELAVIVVRNPSGDVKTYPVVEMEFHPEANQVEYVICPARINDEVATKAREIAVKVSEAFKHVGLLAVEMFLTDPDSYTGDEIIVNEVAPRPHNSGHYSIEASYTNQFEQQVRAILDLPLGNTDSKVGGIMVNLVGAEGHTGDVVYKNIEKIMAMDGVTPHIYGKKQTRPFRKMGHVTIVNEDIDKARAVAQKVKELIKVVATE

SEQ ID NO: 14036 - DNA, 1083 bp, Azospirillum brasilense
  CDS (1)..(1083): transl_table=11
atggcccaccgcatccttccgcccggttcgaccatcggcatgctcggcgacggccagctcggccgcatgaccgcgcttgccgccgcccggctgggctacaagacgcacgtctacgcgccgggatcgcagggcagccccggcgcccaggtcgcggcggccgtcacctccgccggctgggacgacctcgacgcgctggaggccttcgcccgctccgtcgacgtggtgacgctggaatgggagaacgtcccggtcgccgtggtcgagcatctcggccgcttcacccccgtccatcccggcggcacggtgctgtcggtcgcccaggaccgggtggaggagaaatccttcgtcaacgcgctgggcatcggcaccgccccctggcgcgccgcccgcaacgccgacgaggtggcgaaggccgtggcggagatcggcccgcgctgcatcctgaaatccacccgcctcggctatgacggtaaggggcaggcccgcatcgagccgggcagcgacccggcggaggcctgggcggccatcggttccgacgccggcatcgtggagggcttcgtctccttcacctgcgaggtgtcggtgatcgtcgcccgtgggctggacggcagcatggcggcctaccccgccgtggagaaccggcacaaggacggcatcctcgacaggaccatcgctccggcccgcgttcccgcggagacggcggccgaggccgagcgggtcgcccgccgcatcgccgaggcgctggacctcgtcggcgtgctggcggtggagatgttcgtgacgccggacggcggcgtgctggtcaacgagatggcaccgcgcccgcacaactccggccactggaccatggacgcctgccattcctgccagttcgagcagctcgtccgcgccgtctgcggcctgccgctcggctcggtggagcgggtggcggacgccgagatggagaatctgatcggcgccgacgcggaccgctggccggcgctgatggccgagccgggcgcccgcctgcatctctatggcaaggcggagtcccgtcccggccgcaagatgggccatgtgacccggctccatccccgctcctga

SEQ ID NO: 14037 - protein, 360 aa, Azospirillum brasilense
MAHRILPPGSTIGMLGDGQLGRMTALAAARLGYKTHVYAPGSQGSPGAQVAAAVTSAGWDDLDALEAFARSVDVVTLEWENVPVAVVEHLGRFTPVHPGGTVLSVAQDRVEEKSFVNALGIGTAPWRAARNADEVAKAVAEIGPRCILKSTRLGYDGKGQARIEPGSDPAEAWAAIGSDAGIVEGFVSFTCEVSVIVARGLDGSMAAYPAVENRHKDGILDRTIAPARVPAETAAEAERVARRIAEALDLVGVLAVEMFVTPDGGVLVNEMAPRPHNSGHWTMDACHSCQFEQLVRAVCGLPLGSVERVADAEMENLIGADADRWPALMAEPGARLHLYGKAESRPGRKMGHVTRLHPRS

SEQ ID NO: 14038 - DNA, 1113 bp, Magnetospirillum gryphiswaldense
  CDS (1)..(1113): transl_table=11
atgccgacaacccgcatctggtcgtctgagatcatgaacacccccctgccccccggcggcaccatcggtatcatcggcggcggccaattgggccgcatggccgccctggccgccgcccgcctgggctatcgcgtccacgtcttcaccccggaagtcgacagcccgaccgagcaggtggcggccaccgccaccatcgccgcctatgacgacatgaaggcgctggaagccttcgcccgcgccgtcgatgtcgtcaccttcgagttcgagaacattccggcggcttcggtgcggctgctgacctcgctggtgccggtgcgtccgtcgtggaaagtgctggaagtggcccaagaccgcatcagcgaaaagcgcttcttcaacggtatcggcatcgccaccgcgccgtgggcggaaatcaattccgccgccgatctgaaggccggggtcgaacgcatcggtcgtccggcggtgctgaagaccacgcggttgggctatgacggcaagggccaggtcaagatcaccgccaagaccgacctggatcaggcctgggccagcatggacggcgccaccgcggtgctggaaggcttcatcgacttcgccggcgaggtgtcggtgatcgtcgcccgtggtctcgacggggggtgcgccaccttcgatccggcctggaacgtccataccaaccacatcctcgacaccaccaccatccctgcccccatttcccagcccctggccgagcgtgccatccaagtggcgctgaaggcggctgaggcgctggatctggtcggcttgctggcggtggagatgttcgtcaccaaagcgggcgacgttctggtcaacgaaatggcgcccaggccgcacaattccggccattggaccatggatgcctgcgtcaccgaccagttcgagcaattcatccgcgccgtctgcggtctgccgctgggcagccccgaccgtcattccgacgcggtgatgaccaatctgatcggttcggacgtggacaaatggctcgacttcctgaaagagccgggggccaagctgcatctttacggcaaggccgaggcgcgctcgggccgcaagatgggccatgtcacccgaatccgcccgcgccaggactga

SEQ ID NO: 14039 - protein, 370 aa, Magnetospirillum gryphiswaldense
MPTTRIWSSEIMNTPLPPGGTIGIIGGGQLGRMAALAAARLGYRVHVFTPEVDSPTEQVAATATIAAYDDMKALEAFARAVDVVTFEFENIPAASVRLLTSLVPVRPSWKVLEVAQDRISEKRFFNGIGIATAPWAEINSAADLKAGVERIGRPAVLKTTRLGYDGKGQVKITAKTDLDQAWASMDGATAVLEGFIDFAGEVSVIVARGLDGGCATFDPAWNVHTNHILDTTTIPAPISQPLAERAIQVALKAAEALDLVGLLAVEMFVTKAGDVLVNEMAPRPHNSGHWTMDACVTDQFEQFIRAVCGLPLGSPDRHSDAVMTNLIGSDVDKWLDFLKEPGAKLHLYGKAEARSGRKMGHVTRIRPRQD

SEQ ID NO: 14040 - DNA, 1176 bp, Acetobacter aceti
  CDS (1)..(1176): transl_table=11
atgacctccttacattctccgcttaagcccaatgccgttattggcattgtggggggtggccagcttggccgcatgtctgctgttgctgccgcgcgccttggttttcgcacgcatattcttacgccagaggccaacggcccggcggctcaggtctctcacgccgtaacatgcggcaagtatgatgatccgacagcactggatgcctttgcccgcgctgttgatgttgttacctttgaatttgaaaacatcagcgcagatgcactggaccgcctagccaaacactgccctgttcatccttcggggcatattctgcgcatcagtcaggaccgattggcagaaaaaactttttttgcttctgcgggtattccactcgcgccatggcatcctgttaccgatgtcaaaacgctacacgaagccgcagaaaaagtgggtttgccgctgattctcaaaaccactcgcaatggatatgatggcaaaggccagcgccgtgtgcatcacatccatgatctggaagaggctttcaacgctctggcaccacatcctctggttgcagaaggtatggtggattttgcttgcgagattagtgttatggtggcgcgtggtgcagatggcacggtaaggtgctttgacccggcgctgaaccggcactggaacggtattctggatctaacattagcccccgcccccattgacccagatattgccacgcaggccataaaactagccaccaccattgcagaaaagctggagctggttggtattctgggcgttgaaatgtttgttgattgcaccggcaacctgctggtgaatgaaatggccccgcgcccccataattctggccattggaccatgaatgcctgcccgcaggaccaatttgacatgcatatccgtgcagttgcggggctgcctttgccgcacgctgtgcgccattctgatgcaatcatgaaaaatctggtcgggccggaagatatggcgctgctgccgcagattatggccacgcagggctttattccgcatctatatggcaaggcagaagccagagtgggccgtaaaatggggcatgtaaatattctgttcccctacggtgcgctgccaggcaatttgggtattcaggatgccttgggcccattggccaccaaaacggccgctgtggaagatgaagaatctgccagttaa

SEQ ID NO: 14041 - protein, 391 aa, Acetobacter aceti
MTSLHSPLKPNAVIGIVGGGQLGRMSAVAAARLGFRTHILTPEANGPAAQVSHAVTCGKYDDPTALDAFARAVDVVTFEFENISADALDRLAKHCPVHPSGHILRISQDRLAEKTFFASAGIPLAPWHPVTDVKTLHEAAEKVGLPLILKTTRNGYDGKGQRRVHHIHDLEEAFNALAPHPLVAEGMVDFACEISVMVARGADGTVRCFDPALNRHWNGILDLTLAPAPIDPDIATQAIKLATTIAEKLELVGILGVEMFVDCTGNLLVNEMAPRPHNSGHWTMNACPQDQFDMHIRAVAGLPLPHAVRHSDAIMKNLVGPEDMALLPQIMATQGFIPHLYGKAEARVGRKMGHVNILFPYGALPGNLGIQDALGPLATKTAAVEDEESAS

SEQ ID NO: 14042 - DNA, 1080 bp, Thermoplasma volcanium
  CDS (1)..(1080): transl_table=11
gtgatgaacgtaggtattataggaagcgggcagctgggctatatgatgataaatgaaggtcgaaggctcggaaacaagtattttgtcctcgattctaacggagtcggtccggcatctcttattgcagacgcccatttctctgtcgatcagtataaggaattcgttgataagtgcgatgttgtaacttatgaatttgagcacgtgcttgaagaagctctcttgtatgctgaggatcagcacaaattaaagccttcaataaggcccgtagagttaaagaaagaccgttctcttgaaaaagactatttgacaggaatcgggctaaaggtcgctaattacagagttgcccatagtttcagcgaagctgtaagatacgccaaggattttggcaaagcgatgattaagaactctttcgggggctatgacggaaaaggtcagaccatatacgataacggaaattacgaggaacttaaaggtgaaaaattcgtagtagaggaatttgttgactttgattatgaagcctcaataatagcttcaaggagcgaagataaatcgttcaggtaccacgatccttccttcaactataacaggaatgccatatttatatacaactatgccccaataatgcctgctaatatgccggatatagcgaagaagcttatggattctctggattacgtcggtgttatgggcatagaattctacgttaagaatggcgaagttataataaatgagtttgcgccaagagtccataattctggccatcataccctgctaggctcatcaatatcacaattcgaggaacacgtacgcgctataacaggaatccccatatctcagccaatcctgtacaggccatcttcttcaataaatatattaggaacaaaacttagcacggacgcgtggaattccatattatccatgagctcgacccagatatattggtatgggaaggaagagataaggaggaggcgcaaagtcgggcacgttaatgtaactgctggtacagttgaggcgctgatagataagataggaaagatcatggaaataatatacccagatggtattgaaaactatatttga

SEQ ID NO: 14043 - protein, 359 aa, Thermoplasma volcanium
MMNVGIIGSGQLGYMMINEGRRLGNKYFVLDSNGVGPASLIADAHFSVDQYKEFVDKCDVVTYEFEHVLEEALLYAEDQHKLKPSIRPVELKKDRSLEKDYLTGIGLKVANYRVAHSFSEAVRYAKDFGKAMIKNSFGGYDGKGQTIYDNGNYEELKGEKFVVEEFVDFDYEASIIASRSEDKSFRYHDPSFNYNRNAIFIYNYAPIMPANMPDIAKKLMDSLDYVGVMGIEFYVKNGEVIINEFAPRVHNSGHHTLLGSSISQFEEHVRAITGIPISQPILYRPSSSINILGTKLSTDAWNSILSMSSTQIYWYGKEEIRRRRKVGHVNVTAGTVEALIDKIGKIMEIIYPDGIENYI

SEQ ID NO: 14044 - DNA, 1098 bp, Aquifex aeolicus
  CDS (1)..(1098): transl_table=11
atgcttaccgtgggtatcctcggaggtggacagctcggatggatgactatactggaagggagaaaactcgggtttaaatttcacgtccttgaagacaaagaaaacgctcctgcctgcagggttgctgacaggtgtttcagaacaggacaaataagtgaattcgtagactcctgtgacattattacttacgaatttgaacacattaaagatgaagttttggaaaagtgcgagagtaaattaattcccaaccctcaagctctttacgttaaaaaaagcagaatcagggaaaagctttttctgaaaaagcacggttttcccgtgccggagtttttagtaatcaaaagggacgagataatagatgctttaaagagttttaaacttcctgtggtgataaaggcggaaaagcttggctacgacggaaaaggacagtacaggataaaaaaactcgaggatgcaaaccaggttgtcaaaaaccacgacaaagaagaaagtttcataattgaggaattcgtaaagtttgaagcggaaatttcctgtataggtgtaagggacagggaaggtaaaacgtacttttaccctcagccattcaataaacacgaagagggtatacttatttacaactacgtgccctatgcaaagttaaaagaagctgaagaaataactaagaggctaatggagcttttagatatagtgggtgtgttcacggttgaatttttcctgctaaaagacgggagagttttaataaacgaatttgctccgagggttcacaacacgggacactggaccttggatggagcgtacacctcccagtttgaaaacctccttagggctataacggaaatgcctcttggttctacggagttaaaactaccgagcggtatggtgaatatactcgggaaatcttatgaggaaatccctctgaaagaaatcctttccgttgaaggtgcaaaactatactggtatggcaaagagaagaaaccaagaaggaaggtaggacacgttaacgtggtgggaaggtcaaaggaagaagtagttgaaaaagtagaaagagtcttcacacttctcaaaggctcaagagaaaaactcccagcaccatga

SEQ ID NO: 14045 - protein, 365 aa, Aquifex aeolicus
MLTVGILGGGQLGWMTILEGRKLGFKFHVLEDKENAPACRVADRCFRTGQISEFVDSCDIITYEFEHIKDEVLEKCESKLIPNPQALYVKKSRIREKLFLKKHGFPVPEFLVIKRDEIIDALKSFKLPVVIKAEKLGYDGKGQYRIKKLEDANQVVKNHDKEESFIIEEFVKFEAEISCIGVRDREGKTYFYPQPFNKHEEGILIYNYVPYAKLKEAEEITKRLMELLDIVGVFTVEFFLLKDGRVLINEFAPRVHNTGHWTLDGAYTSQFENLLRAITEMPLGSTELKLPSGMVNILGKSYEEIPLKEILSVEGAKLYWYGKEKKPRRKVGHVNVVGRSKEEVVEKVERVFTLLKGSREKLPAP

SEQ ID NO: 14046 - DNA, 1140 bp, Bacillus subtilis
  CDS (1)..(1140): transl_table=11
ttgtctaaacaaatcatctatccgggagctgtaatcggcattatcggcggcggccagcttgggaaaatgatggctgtgtccgccaaacaaatggggtataaagtcgcggtcgttgatccggtgaaagattcgccgtgcgggcaggttgcggatgtcgaaattaccgctcattataatgaccgtgaagcgattcgaaaattggctgaaatcagcgatatcatcacatatgagtttgaaaacatcgactatgatgcgctgcattggctaaaagatcatgcgtatctcccgcaaggaagtgagctgctgcttattacccaaaaccgtgaaacagagaaaaaagcaattcaatccgcgggctgtgaagtcgcaccgtacagcatcgtcaaaacaaagaatgaattgaaacaggcagtacaggagctcaggcttccggcagtgctgaaaacatgccgcggcgggtacgacggcaaaggccaatttgtgataaaagaagaggcgcaaatggagcaggcagccgctctgttagaacacggaacttgcattcttgaaagctgggtttcttttaaaatggaactgtcggtgatcgtcgttagatcggtaaacggtgaaatttcaacatttccgacagctgaaaacattcaccacaacaatattcttttccaaagcatcgtgcccgcagtagagaaagggattcagcagaaggctgctgatctcgcagttaagcttgcagatgagcttaaccttgtcggaccgcttgctgttgagatgttcctgacagaggacggagagcttttggtcaatgaactggcgccaagaccgcacaattcagggcattatacgctggacctttgcgagacgagccagtttgagcagcatatcagagcggtatgcgggcttccgcttgggaagacagatttgctgaagccgggcatgatggtgaatcttctcggcgatgaagtgaagcttgttgaggaagacccggagcttttaaaagaggcaaagctatatatatacggaaaacatgaaatcaaaaaaggccgcaaaatggggcatattacatttatgaagcagcctgaagacgaatggattcaggagatcacaaataaatggatgaatagagacggaggacaagcagaatga

SEQ ID NO: 14047 - protein, 379 aa, Bacillus subtilis
MSKQIIYPGAVIGIIGGGQLGKMMAVSAKQMGYKVAVVDPVKDSPCGQVADVEITAHYNDREAIRKLAEISDIITYEFENIDYDALHWLKDHAYLPQGSELLLITQNRETEKKAIQSAGCEVAPYSIVKTKNELKQAVQELRLPAVLKTCRGGYDGKGQFVIKEEAQMEQAAALLEHGTCILESWVSFKMELSVIVVRSVNGEISTFPTAENIHHNNILFQSIVPAVEKGIQQKAADLAVKLADELNLVGPLAVEMFLTEDGELLVNELAPRPHNSGHYTLDLCETSQFEQHIRAVCGLPLGKTDLLKPGMMVNLLGDEVKLVEEDPELLKEAKLYIYGKHEIKKGRKMGHITFMKQPEDEWIQEITNKWMNRDGGQAE

SEQ ID NO: 14048 - DNA, 1089 bp, Brucella melitensis
  CDS (1)..(1089): transl_table=11
atggacaagacatctctcaagcccggctccaccatcggcattatcggcgggggccagcttggccgtatgctcgccatggcagcggcgcgcttcggttatgaaaccataatccttgagccgcaggccggttgcccggcagcacaggttgccaatcgccagattgtcgccgcctatgatgacccgaaggcgctggccgaacttgccgccgcttccgacgtcatcacctatgaatttgaaaatgtgccagtcagcgccgccgacaagctggctgaaacggcgcttgttctgcccccgcccgccgcactggaaatctctcaggaccgcttcacagaaaagcagtttctcaacgaaagcggcattgaaaccgcgccctggcggctcgtggatgacgaggaaacgctcatcgccgcgctcggcgcactgggcgggcgtggcatcctcaagatacggcgtctgggttatgacggcaaggggcaggtgcgccttgcctccctcgatgaaacccaggcctgcaacgcttttgcagccatcaacaaggcgcctgcgattctcgaaggcttcgtggaattcgagcgcgaagtctccgtcatcgccgcgcgcgatcgcagcggcaatgtcgccatcttcgatcttgcggaaaacgtccacaaggatggcattctcgccacgtccacagtgcctgccgcgatcagcgtacagacggcagaagccgcgcgcacagccgccgaaaaactgttgcacgcgctggactatgtcggtgtgctggggcttgaattcttcgtgctgaaggacggcacgctgctcgccaatgaatttgccccgcgtgtgcataattcgggccactggacggaagcagcctgcgccatttcccaatttgagcagcatatccgcgctgtggcgggactgccgctcggcaatacggatcgccatagcgactgtgtgatggaaaacctgattggcgacgatatcgaaaaggttccggcgattctctgcgagaagaacgccgtgctgcatctttacggtaaaaaggaagctcgcgcgggccggaaaataggccatgtgacccgcataaagccccgcacaatttaa

SEQ ID NO: 14049 - protein, 362 aa, Brucella melitensis
MDKTSLKPGSTIGIIGGGQLGRMLAMAAARFGYETIILEPQAGCPAAQVANRQIVAAYDDPKALAELAAASDVITYEFENVPVSAADKLAETALVLPPPAALEISQDRFTEKQFLNESGIETAPWRLVDDEETLIAALGALGGRGILKIRRLGYDGKGQVRLASLDETQACNAFAAINKAPAILEGFVEFEREVSVIAARDRSGNVAIFDLAENVHKDGILATSTVPAAISVQTAEAARTAAEKLLHALDYVGVLGLEFFVLKDGTLLANEFAPRVHNSGHWTEAACAISQFEQHIRAVAGLPLGNTDRHSDCVMENLIGDDIEKVPAILCEKNAVLHLYGKKEARAGRKIGHVTRIKPRTI

SEQ ID NO: 14050 - DNA, 1242 bp, Corynebacterium ammoniagenes
  CDS (1)..(1242): transl_table=11
atgaaacgcgtgagtgaacaagcaggaaacccagacggaaaccctcaagcacatgttcccggcatgccggttatcgccgttattggtgatggccagctagctcgcatgatgcaaaccgccgccattgagctcggccaatcgctgcgccttcttgccggcgcacgcgatgcctctgcggcacaagtatgcgcggatgtagtgcttggtgattacaccaactacgacgacttgctcaaagccgtcgacggtgccaccgctgtcacttttgaccatgagcacgtgcctaatgagcacctcaccgcgttgatcgatgcaggctataacgatcagccacaacctgctgcgctgattaacgcccaagacaaattggttatgcgcgagcgcctcgccgagctgggcgcacccgtgccgcgctttgcgccgattgaatctgcccaagatgcgtacgatttttggaccttgacgtccgggcaggtctgtctgaaggcgcgccggggtggctacgacggcaaaggcgtgtggtttccgaataatgaatctgagctgactgctttggtctctgacctttcgcgccgcggcgtggccttgatggctgaagagaaggttggctggtcccgcgagctttccgtgctggtcgcgcggactccctcgggcgaggttgctacttggccgctgactgagtctgtgcagcgcaacggtgtgtgcgctgaagctgtcgcgccagccccgggagttgacccgcagctgcagcaacgcgctgagacactgggtgaaaagattgccaccgagttgggtgtaactggtgtgctcgcggtagagctttttgcatttgcgaatgagtccggtgcggaagatatcgcggttaatgaactggcaatgcgcccgcacaataccggccactggaccctagtaggttctgtgacctcccaatttgagcagcacctgcgcgcggtgatggatgagccactgggggatacatccacgcttgccccagtcaccgtgatggccaacgtcttaggcgctgacgaagaccaaagatgccaatgggcgagcgtgccgagaagtggcgcgcccgttcccgcgaccaaagtccatctctacggcaagggcatcgcccaaggccgtaagattggccacgtgaacctcaccggtgaggacgaagaggcaacccgtcgcgatgctcgcttggctgcggatttcctcgtgaacgccgcgtggtctgataactggtccgctaaatag

SEQ ID NO: 14051 - protein, 413 aa, Corynebacterium ammoniagenes
MKRVSEQAGNPDGNPQAHVPGMPVIAVIGDGQLARMMQTAAIELGQSLRLLAGARDASAAQVCADVVLGDYTNYDDLLKAVDGATAVTFDHEHVPNEHLTALIDAGYNDQPQPAALINAQDKLVMRERLAELGAPVPRFAPIESAQDAYDFWTLTSGQVCLKARRGGYDGKGVWFPNNESELTALVSDLSRRGVALMAEEKVGWSRELSVLVARTPSGEVATWPLTESVQRNGVCAEAVAPAPGVDPQLQQRAETLGEKIATELGVTGVLAVELFAFANESGAEDIAVNELAMRPHNTGHWTLVGSVTSQFEQHLRAVMDEPLGDTSTLAPVTVMANVLGADEDQRCQWASVPRSGAPVPATKVHLYGKGIAQGRKIGHVNLTGEDEEATRRDARLAADFLVNAAWSDNWSAK

SEQ ID NO: 14052 - DNA, 1089 bp, Haemophilus influenzae
  CDS (1)..(1089): transl_table=11
atgcaaaactccaccttatacccaacggtttatgtactcggcaacggacaactcggcagaatgttacgttacgctggtgcacctttagatatttatgttgaacccttagccttcaatgcaccagtttttgacttacctgaaaatgcgatcatcacggcggaaattgaacgctgggaaaaaacgcctttgactgaattactcggcaatcataaaaacttcgtcaatcaacatatatttggattattggcagatcgttttactcaaaaatccttacttgatgaactgaatctttctacctcgccttggtgtttattaaaagataaaaatcaatggaatgatcttttccaaactgttggcgagaaagtcgtcgttaaacgtagaacaggtggatatgatggacgaggtcaatggattatcagagatgaaaatagagcggacatcaccgatgatttatttggtgaagtgatcgcagaaaaatttattcctttcgattatgaagtatctattgtaggcgcaaggtttaaaaatggcgaaaagcgtttttatcccgttacacataacctgcaacaaaacggtattttgcgttacagtgtggttgattgtgcttttcctcaacaatccgtacaacaaaagcaagcagaaacaatgctcggcaaaattatggataaattaggctatgtgggtgtgatggcaatggaatgttttgttgtaggcgacaaattactgattaacgaacttgcgcctcgtgtacataacagtggacattggacacaactaggatgctcgattagccaatttgaattacatttacgtgcgctactcaatttgccaacgcctgaattacaaacattcgccccaagtgtaatgattaatttaatcggcaccaatcataaccctaagtggcttaacataccttttgcacaacttcattggtacggtaaagaagtgagaattggacgtaaagttgggcatatcaatctttcccatcctaataaagcggtcattattcaacaattagaaaagctttgcactgaattaccagaagattatcaatcaggattaaattgggcgattgaaaaactaaaataa

SEQ ID NO: 14053 - protein, 362 aa, Haemophilus influenzae
MQNSTLYPTVYVLGNGQLGRMLRYAGAPLDIYVEPLAFNAPVFDLPENAIITAEIERWEKTPLTELLGNHKNFVNQHIFGLLADRFTQKSLLDELNLSTSPWCLLKDKNQWNDLFQTVGEKVVVKRRTGGYDGRGQWIIRDENRADITDDLFGEVIAEKFIPFDYEVSIVGARFKNGEKRFYPVTHNLQQNGILRYSVVDCAFPQQSVQQKQAETMLGKIMDKLGYVGVMAMECFVVGDKLLINELAPRVHNSGHWTQLGCSISQFELHLRALLNLPTPELQTFAPSVMINLIGTNHNPKWLNIPFAQLHWYGKEVRIGRKVGHINLSHPNKAVIIQQLEKLCTELPEDYQSGLNWAIEKLK

SEQ ID NO: 14054 - DNA, 1290 bp, Mycobacterium bovis
  CDS (1)..(1290): transl_table=11
atgatggccgtggcgagctcacgcaccccggcggtcacctcgttcattgcccccctcgttgcgatggtcggtggcggtcagctggcccggatgacccatcaggctgccatcgcgctggggcagaacctccgtgtattggtcacctcggcagatgaccctgccgcgcaggtcacccccaacgtggtgatcggctcgcacaccgatcttgccgccttgcgccgcgttgcggccggcgccgacgtgctgacctttgaccacgagcacgtcccgaacgagctgttggagaagctagtcgccgatggcgtcaatgtcgcaccgtcgccgcaggcgctggtgcacgcccaggacaaactcgtcatgcggcagcgtctggctgcagcaggcgtcgccgtgccccgctacgcgggcatcaaagaccccgacgaaatcgacgtcttcgccgcacgtgtcgacgccccgatcgtggtcaaggcagtgcgcgggggttacgacggccggggcgttcggatggcacgtgatgtggcggatgcccgtgatttcgctcgcgaatgcctggctgacggcgtggcggtgctggtcgaggaacgggtggacctgcgccgcgagctgtcggcactggtggcgcgttcgccgttcggccagggtgcggcgtggccggtggtccagacggtgcaacgtgacggcacgtgtgtgctggtgatcgcgccggcgccggcgctgcccgacgacctggccaccgcggcgcaacggttggcgttgcagctggccgacgaactcggtgtggtcggcgtgctcgccgtcgagctgttcgagacgaccgacggggcgttgctggtcaacgagctcgcgatgcggccacataattccgggcactggaccatcgacggggcgcgcaccagccagttcgagcagcatctgcgcgcggtcttggactacccgctcggcgacagcgacgccgtggtgcccgtgacggtgatggccaatgtgctcggcgccgcgcagccgccggccatgagcgtcgacgagcggctgcaccatctgtttgcgcgaatgcccgacgcccgggttcacctctacggcaaggccgagcgacccggtcgcaaggtggggcatatcaacttccttggctccgatgtcgcccagttgtgtgaacgcgctgagctggcggcacactggttgtcccatgggcggtggactgacggatgggacccacaccgcgccagcgacgatgcagtgggggtaccacccgcgtgcgggggacgaagcgatgaggaggagcggcgcctatga

SEQ ID NO: 14055 - protein, 429 aa, Mycobacterium bovis
MMAVASSRTPAVTSFIAPLVAMVGGGQLARMTHQAAIALGQNLRVLVTSADDPAAQVTPNVVIGSHTDLAALRRVAAGADVLTFDHEHVPNELLEKLVADGVNVAPSPQALVHAQDKLVMRQRLAAAGVAVPRYAGIKDPDEIDVFAARVDAPIVVKAVRGGYDGRGVRMARDVADARDFARECLADGVAVLVEERVDLRRELSALVARSPFGQGAAWPVVQTVQRDGTCVLVIAPAPALPDDLATAAQRLALQLADELGVVGVLAVELFETTDGALLVNELAMRPHNSGHWTIDGARTSQFEQHLRAVLDYPLGDSDAVVPVTVMANVLGAAQPPAMSVDERLHHLFARMPDARVHLYGKAERPGRKVGHINFLGSDVAQLCERAELAAHWLSHGRWTDGWDPHRASDDAVGVPPACGGRSDEEERRL

SEQ ID NO: 14056 - DNA, 1320 bp, Mycobacterium leprae
  CDS (1)..(1320): transl_table=11
atgatggctgtgccgagtagatgctcgcttggagttgctccattggttgccatggtcggtggcggtcaactggctcggatgacccatcaagccgcgatcgcgctggggcagaccctgcgggtgttagctaccgctgcagacgaacccgctgctcaggtcacccccgatgtggtgatcggctcgcacactgatcttgaagacctgcgccgcgttgccctcggagccgatgcgttgacgttcgatcacgaacacgtcccgactgaactgctggacaaactggtggccgaaggcatcaatgtggcaccgtcgccgcaagctctggtgcacgcccaggacaagctggtcatgcggcggcgattggcggcgctgggagctgcgatgcctcgcttcatggcattagacagtgtggacgacttggccgaaatcgatgcgttcgcgcagcgccttacgggttcgaaagatgccccgatggtggtcaaggcggtccgcgggggttatgacggccggggggtgcagatggtccgcgactcggcacacgcccgcgaggtcgcctccggatatctagtcgacggaatgccggtcctggttgaggagcgagtggaactgcgtcgcgaattgtccgcgctggtagcgcgctcgccgttcggccagggtgcagcctggccagtcgtggagacggtgcaacgggacgggatttgcgttttggtggtcgcaccggcgttggcgttggccgacgacctggcctcggctgcgcagcagctggcgttgcgattggccgctgaactcggcgtcgtcggtgtgttcgcggtcgagttgttcgaaaccgccgacggtgctttgctggtgaacgagctcgcaatgcggccgcacaactccggacactggacaatggacggtgctcgcaccagccagttcgagcagcatctccgtgcggtgctagactatcccctcggcgagaccgacgccgtcgcgccggtgaccgtgatggttaacgtgctaggcgccccacaaccgccgacgctgagtgtagtgactatggatgaacggctacaccacctgtttgcgcggatgcccgatgctcgggttcatctttacgacaaggttgagcgtcctggtcgcaaggttgggcacatcaattttcgcggcaccgataaagaccgaaaaaaccccactaagctgcgtgaacgcgctgagttggcagcgcattggctatcacacgggcagtggacggatggatgggatccacaccgtgccggcgacgatgtagtggagatatctctcgcttgcggaggacgaaacgatgcgcagaggcagcgctga

SEQ ID NO: 14057 - protein, 439 aa, Mycobacterium leprae
MMAVPSRCSLGVAPLVAMVGGGQLARMTHQAAIALGQTLRVLATAADEPAAQVTPDVVIGSHTDLEDLRRVALGADALTFDHEHVPTELLDKLVAEGINVAPSPQALVHAQDKLVMRRRLAALGAAMPRFMALDSVDDLAEIDAFAQRLTGSKDAPMVVKAVRGGYDGRGVQMVRDSAHAREVASGYLVDGMPVLVEERVELRRELSALVARSPFGQGAAWPVVETVQRDGICVLVVAPALALADDLASAAQQLALRLAAELGVVGVFAVELFETADGALLVNELAMRPHNSGHWTMDGARTSQFEQHLRAVLDYPLGETDAVAPVTVMVNVLGAPQPPTLSVVTMDERLHHLFARMPDARVHLYDKVERPGRKVGHINFRGTDKDRKNPTKLRERAELAAHWLSHGQWTDGWDPHRAGDDVVEISLACGGRNDAQRQR

SEQ ID NO: 14058 - DNA, 1125 bp, Staphylococcus aureus
  CDS (1)..(1125): transl_table=11
atgaacttcaataaattaaagtttggtgcgactattggcattattggtggtggtcagcttggaaagatgatggcacaatcagctcaaaaaatgggttataaagtggttgtattggatccttctgaagattgtccatgtagatacgttgcacacgaatttatacaagccaagtatgacgatgaaaaggcactcaatcaattaggacaaaaatgtgatgtgattacttatgaatttgaaaacatttcagcccaacaattaaaactattatgtgaaaagtacaatattccgcaaggttaccaagctatacagttattacaagatcgcttaactgaaaaagaaacattaaaaagtgctggtaccaaagttgtcccgttcatttcagtaaaagaatctacagatattgacaaagcaattgaaacattaggatatccttttattgtaaaaactagatttggtggctacgatggcaaaggtcaagttttaattaacaacgaaaaagacttacaagaaggttttaaattaattgaaactagtgaatgcgtagctgaaaaatatttgaatatcaagaaagaagtatctcttactgttacaagaggaaacaacaatcaaatcacttttttcccattacaagaaaatgagcatagaaatcaaatacttttcaaaacaattgttccagcgagaatagataaaacagctgaggcgaaagagcaagttaataaaattatccaatcgattcatttcattggaacatttacagttgaattttttatagatagtaacaaccaattgtatgtgaacgagatagcaccaaggcctcacaattccggacattattcaattgaagcatgtgattattcacaatttgatactcatattttagcagttaccggacaatcattaccaaattcaattgaattattaaagccagcagtcatgatgaacttactaggtaaagatttagatttattggaaaatgaatttaatgaacatccagagtggcacttacatatttatggtaagtctgagcgtaaagatagcagaaaaatggggcatatgactgtactaacgaatgatgtaaaccaaactgaacaagatatgtacgctaaatttgaggggagtaattaa

SEQ ID NO: 14059 - protein, 374 aa, Staphylococcus aureus
MNFNKLKFGATIGIIGGGQLGKMMAQSAQKMGYKVVVLDPSEDCPCRYVAHEFIQAKYDDEKALNQLGQKCDVITYEFENISAQQLKLLCEKYNIPQGYQAIQLLQDRLTEKETLKSAGTKVVPFISVKESTDIDKAIETLGYPFIVKTRFGGYDGKGQVLINNEKDLQEGFKLIETSECVAEKYLNIKKEVSLTVTRGNNNQITFFPLQENEHRNQILFKTIVPARIDKTAEAKEQVNKIIQSIHFIGTFTVEFFIDSNNQLYVNEIAPRPHNSGHYSIEACDYSQFDTHILAVTGQSLPNSIELLKPAVMMNLLGKDLDLLENEFNEHPEWHLHIYGKSERKDSRKMGHMTVLTNDVNQTEQDMYAKFEGSN

SEQ ID NO: 14060 - DNA, 1125 bp, Staphylococcus aureus
  CDS (1)..(1125): transl_table=11
atgaacttcaataaattaaagtttggtgcgactattggcattattggtggtggtcagcttggaaagatgatggcacaatcagctcaaaaaatgggttataaagtggttgtattggatccttctgaagattgtccatgtagatacgttgcacacgaatttatacaagccaagtatgacgatgaaaaggcactcaatcaattaggacaaaaatgtgatgtgattacttatgaatttgaaaacatttcagcccaacaattaaaactattatgtgaaaagtacaatattccgcaaggttaccaagctatacagttattacaagaccgcttaactgaaaaagaaacattaaaaagtgctggtaccaaagttgtcccgttcatttcagtaaaagaatctacagatattgacaaagcaattgaaacattaggatatccttttattgtaaaaactagatttggtggctacgatggcaaaggtcaagttttaattaacaacgaaaaagacttacaagaaggttttaaattaattgaaactagtgaatgcgtagctgaaaaatatttgaatatcaagaaagaagtatctcttactgttacaagaggaaacaacaatcaaatcacttttttcccattacaagaaaatgagcatagaaatcaaatacttttcaaaacaattgttccagcgagaatagataaaacagctgaggcgaaagagcaagttaataaaattatccaatcgattcatttcattggaacatttacagtggaattttttatagatagtaacaaccaattgtatgtgaacgagattgcaccaaggcctcacaattccggacattattcaattgaagcatgtgattattcacaatttgatactcatattttagcagttaccggacaatcattaccaaattcaattgaattattaaagcctgcagtcatgatgaacttactaggtaaagacttagatttattggaaaatgaatttaatgaacatccagagtggcacttacatatttatggtaagtctgggcgtaaagatagcagaaaaatggggcatatgactgtactaacgaatgatgtaaaccaaactgaacaagatatgtacgctaaatttgaggggagtaattaa

SEQ ID NO: 14061 - protein, 374 aa, Staphylococcus aureus
MNFNKLKFGATIGIIGGGQLGKMMAQSAQKMGYKVVVLDPSEDCPCRYVAHEFIQAKYDDEKALNQLGQKCDVITYEFENISAQQLKLLCEKYNIPQGYQAIQLLQDRLTEKETLKSAGTKVVPFISVKESTDIDKAIETLGYPFIVKTRFGGYDGKGQVLINNEKDLQEGFKLIETSECVAEKYLNIKKEVSLTVTRGNNNQITFFPLQENEHRNQILFKTIVPARIDKTAEAKEQVNKIIQSIHFIGTFTVEFFIDSNNQLYVNEIAPRPHNSGHYSIEACDYSQFDTHILAVTGQSLPNSIELLKPAVMMNLLGKDLDLLENEFNEHPEWHLHIYGKSGRKDSRKMGHMTVLTNDVNQTEQDMYAKFEGSN

SEQ ID NO: 14062 - DNA, 1125 bp, Staphylococcus aureus
  CDS (1)..(1125): transl_table=11
atgaacttcaataaattaaagtttggtgcgactattggcattattggtggtggtcagcttggaaagatgatggcacaatcagctcaaaaaatgggttataaagtggctgtattggatcctgctgaagattgtccatgtagatacgttgcacacgaatttatacaagccaagtatgacgatgaaaaggcactcaatcaattaggacaaaaatgtgatgtgattacttatgaatttgaaaacatttcagcccaacaattaaaactattatgtgaaaagtacaatattccgcaaggttaccaagctatacagttattacaagaccgcttaactgaaaaagaaacattaaaaagtgctggtaccaaggttgtcccattcatttcagtaaaagaatctaaagatattgacaaagcaattgaaacattaggatatccttttattgtaaaaactagatttggtggctacgatggcaaaggtcaagttttaattaacaacgaaaaagacttacaagaaggtattaaattaattgaaactagtgaatgcgtagctgaaaaatatttgaatatcaagaaagaagtatcacttactgttacaagaggaaacaacaatcaaatcacttatttcccattacaagaaaatgagcatagaaatcaaatacttttcaaaacaattgttccagcgagaatagataaaatagctgaggcgaaagagcaagttaataaaattatccaatcgattcatttcattggaacatttacagttgaattttttatagatagtaataaccaattgtatgtgaacgagattgcaccaaggcctcacaattccggacattattcaattgaggcatgtgattattcacaatttgatactcatattttagcagttaccggacaatcattaccaaattcaattgaattattaaagcctgcagtcatgatgaacttactaggtaaagacttagatttattggaaaatgaatttaatgaacatccagagtggcacttacatatttatggtaagtctgagcgtaaagatagcagaaaaatggggcatatgactgtactaacgaatgatgtaaaccaaactgaacaagatatgtacgctaaatttgaggggagtaattaa

SEQ ID NO: 14063 - protein, 374 aa, Staphylococcus aureus
MNFNKLKFGATIGIIGGGQLGKMMAQSAQKMGYKVAVLDPAEDCPCRYVAHEFIQAKYDDEKALNQLGQKCDVITYEFENISAQQLKLLCEKYNIPQGYQAIQLLQDRLTEKETLKSAGTKVVPFISVKESKDIDKAIETLGYPFIVKTRFGGYDGKGQVLINNEKDLQEGIKLIETSECVAEKYLNIKKEVSLTVTRGNNNQITYFPLQENEHRNQILFKTIVPARIDKIAEAKEQVNKIIQSIHFIGTFTVEFFIDSNNQLYVNEIAPRPHNSGHYSIEACDYSQFDTHILAVTGQSLPNSIELLKPAVMMNLLGKDLDLLENEFNEHPEWHLHIYGKSERKDSRKMGHMTVLTNDVNQTEQDMYAKFEGSN

SEQ ID NO: 14064 - DNA, 1125 bp, Staphylococcus aureus
  CDS (1)..(1125): transl_table=11
atgagcttcaataaattaaagtttggtgcgactattggcattattggtggtggtcagcttggaaagatgatggcacaatcagctcaaaaaatgggttataaagtggttgtattggatccttctgaagattgtccatgtagatacgttgcacacgaatttatacaagccaagtatgacgatgaaaaggcactcaatcaattaggacaaaaatgtgatgtgattacttatgaatttgaaaacatttcagcccaacaattaaaactattatgtgaaaagtacaatattccgcaaggttaccaagctatacagttattacaagaccgcttaactgaaaaagaaacattaaaaagtgctggtaccaaagttgtcccgttcatttcagtaaaagaatctacagatattgacaaagcaattgaaacattaggatatccttttattgtaaaaactagatttggtggctacgatggcaaaggtcaagttttaattaacaacgaaaaagacttacaagaaggttttaaattaattgaaactagtgaatgcgtagctgaaaaatatttgaatatcaagaaagaagtatctcttactgttacaagaggaaacaacaatcaaatcacttttttcccattacaagaaaatgagcatagaaatcaaatacttttcaaaacaattgttccagcgagaatagataaaacagctgaggcgaaagagcaagttaataaaattatccaatcgattcatttcattggaacatttacagttgaattttttatagatagtaacaaccaattgtatgtgaacgagatagcaccaaggcctcacaattccggacattattcaattgaagcatgtgattattcacaatttgatactcatattttagcagttaccggacaatcattaccaaattcaattgaattattaaagccagcagtcatgatgaacttactaggtaaagatttagatttattggaaaatgaatttaatgaacatccagagtggcacttacatatttatggtaagtctgagcgtaaagatagcagaaaaatggggcatatgactgtactaacgaatgatgtaaaccaaactgaacaagatatgtacgctaaatttgaggggagtaattaa

SEQ ID NO: 14065 - protein, 374 aa, Staphylococcus aureus
MSFNKLKFGATIGIIGGGQLGKMMAQSAQKMGYKVVVLDPSEDCPCRYVAHEFIQAKYDDEKALNQLGQKCDVITYEFENISAQQLKLLCEKYNIPQGYQAIQLLQDRLTEKETLKSAGTKVVPFISVKESTDIDKAIETLGYPFIVKTRFGGYDGKGQVLINNEKDLQEGFKLIETSECVAEKYLNIKKEVSLTVTRGNNNQITFFPLQENEHRNQILFKTIVPARIDKTAEAKEQVNKIIQSIHFIGTFTVEFFIDSNNQLYVNEIAPRPHNSGHYSIEACDYSQFDTHILAVTGQSLPNSIELLKPAVMMNLLGKDLDLLENEFNEHPEWHLHIYGKSERKDSRKMGHMTVLTNDVNQTEQDMYAKFEGSN

SEQ ID NO: 14066 - DNA, 1128 bp, Staphylococcus epidermidis
  CDS (1)..(1128): transl_table=11
atgaacttcagtaaacttaaatttggcgcgacaataggaatcattggcggagggcagttaggaaaaatgatggctcagtctgcacaaaaaatgggttataaggtgattgtcctagatcctaatgaagactgtccttgtcgttatgtcgcacatcagtttattcatgcaaattatgatgatgagcaagctttaaatcagttaggtgaaaattctgatgttgttacttatgagtttgaaaatatttcgtctgaacaattaaaaaaactcactaagttatatcatattccccaagggtaccaagctattgaactattacaagataggctaaccgagaagcaaacattactagaagcaaatactcaaattgttccttttgtacaaattcaaacaaatcaagacttattaaaagccatagaaaaattaggctttccgttcatagtgaaaacacgttttggtggatatgatggtaaaggacaaattttggtaagaaatgattcggaattagacgaagcataccagctagttgagaagcaagaatgtgttgctgaacaatatcttgatattcaaaaggaagtatctcttacagtaacaattggaaatgaacaacaaacaacatactttcctcttcaagaaaatgaacatcaaaatcaaatattatttaaaacagtcgttccagcaagatctgataaagaaaatgaagcacgtaaggaagttgagaaaatcactcgcgcaattcattttgtgggaacctttacagtagaattctttattgataaagaaaataacttatatgtaaatgaaattgcaccaagaccacataattctggacactattctatagaagcttgtgattattcacagtttgatacacatattttagccataactggtcaaaaacttccgcaagctattgaattattaaagccaacagtaatgatgaatttattaggtcgcgatttggatttacttgaaaatgaatttagcagacatccagattggcatattcacatttacggtaagaaagaaagaaaacctgatagaaaaatgggacacatgactttactgacggatgatgtcaatcaaacagaacaatatatgttaatgaaatttgaagggagagacaagtaa

SEQ ID NO: 14067 - protein, 375 aa, Staphylococcus epidermidis
MNFSKLKFGATIGIIGGGQLGKMMAQSAQKMGYKVIVLDPNEDCPCRYVAHQFIHANYDDEQALNQLGENSDVVTYEFENISSEQLKKLTKLYHIPQGYQAIELLQDRLTEKQTLLEANTQIVPFVQIQTNQDLLKAIEKLGFPFIVKTRFGGYDGKGQILVRNDSELDEAYQLVEKQECVAEQYLDIQKEVSLTVTIGNEQQTTYFPLQENEHQNQILFKTVVPARSDKENEARKEVEKITRAIHFVGTFTVEFFIDKENNLYVNEIAPRPHNSGHYSIEACDYSQFDTHILAITGQKLPQAIELLKPTVMMNLLGRDLDLLENEFSRHPDWHIHIYGKKERKPDRKMGHMTLLTDDVNQTEQYMLMKFEGRDK

SEQ ID NO: 14068 - DNA, 1128 bp, Staphylococcus epidermidis
  CDS (1)..(1128): transl_table=11
atgaacttcagtaaacttaaatttggcgcgacaataggaatcattggcggagggcagttaggaaaaatgatggctcagtctgcacaaaaaatgggttataaggtgattgtcctagatcctaatgaagactgtccttgtcgttatgtcgcacatcagtttattcatgcaaattatgatgatgagcaagctttaaatcagttaggtgaaaattctgatgttgttacttatgagtttgaaaatatttcgtctgaacaattaaaaaaactcactcagttatatcatattccccaagggtaccaagctattgaactattacaagataggctaaccgagaagcaaacattactagaagcaaatactcaaattgttccttttgtacaaattcaaacaaatcaagacttattaaaagccatagaaaaattaggctttccgttcatagtgaaaacacgttttggtggatatgatggtaaaggacaaattttggtaagaaatgattcggaattagacgaagcataccagctagttgagaagcaagaatgtgttgctgaacaatatcttgatattcaaaaggaagtatctcttacagtaacaattggaaatgaacaacaaacaacatactttcctcttcaagaaaatgaacatcaaaatcaaatattatttaaaacagtcgttccagcaagatctgataaagaaaatgaagcacgtaaggaagttgagaaaatcactcgcgcaattcattttgtgggaacctttacagtagaattctttattgataaagaaaataacttatatgtaaatgaaattgcaccaagaccacataattctggacactattctatagaagcttgtgattattcacagtttgatacacatattttagccataactggtcaaaaacttccgcaagctattgaattattaaagccaacagtaatgatgaatttattaggtcgcgatttggatttacttgaaaatgaatttagcagacatccagattggcatattcacatttacggtaagaaagaaagaaaacctgatagaaaaatgggacacatgactttactgacggatgatgtcaatcaaacagaacaatatatgttaatgaaatttgaagggagagacaagtaa

SEQ ID NO: 14069 - protein, 375 aa, Staphylococcus epidermidis
MNFSKLKFGATIGIIGGGQLGKMMAQSAQKMGYKVIVLDPNEDCPCRYVAHQFIHANYDDEQALNQLGENSDVVTYEFENISSEQLKKLTQLYHIPQGYQAIELLQDRLTEKQTLLEANTQIVPFVQIQTNQDLLKAIEKLGFPFIVKTRFGGYDGKGQILVRNDSELDEAYQLVEKQECVAEQYLDIQKEVSLTVTIGNEQQTTYFPLQENEHQNQILFKTVVPARSDKENEARKEVEKITRAIHFVGTFTVEFFIDKENNLYVNEIAPRPHNSGHYSIEACDYSQFDTHILAITGQKLPQAIELLKPTVMMNLLGRDLDLLENEFSRHPDWHIHIYGKKERKPDRKMGHMTLLTDDVNQTEQYMLMKFEGRDK

SEQ ID NO: 14070 - DNA, 1098 bp, Sulfolobus solfataricus
  CDS (1)..(1098): transl_table=11
atgttctcagtactagactggaagcctaaaattggaatattaggaggaggacagctcggctggatgatagtattagagggtagaaaatacccatttactttttacgtattagagaacgataagaatgctccagcttgcagaattgcagataggtgtttctctcctcaagattataaggaattcgttgattcctcagacgttataacatttgagttcgaacacgtgtatgaaaaggcattagagtatgctgagtatagtggcaagctattacctagacttaactctgtagagttgaagagagagcgttataaggagaagctgttctatagacaacataatttaccaactcctagattctatgtagcagaggatggtgaggaagcattaaagatattaagagaggaattcaataatgtcggagttattaaggaatctaaaggaggatatgatggtaaggggcaatatttcatctttaatgacgttgagaaatatcaatttctaagggaaaagaaagagaagatggtcgttgaggagtatgtaaaatttgattttgaggcctccattattatagcaagggataagagaggtgtttttattagttaccctccaacttataattataatgaaaaaggtattttagtttataattatgggccgtataataatcagaatatagtagagattgcaagaaggttaagtgaggagttggattacgtaggaattatgggcgttgaggtattcgtagttaacggtaaagttttaattaatgagtttgccccaagagttcacaatactgggcactatactcttgacggcgctctaatctctcaatttgaacaacacctaagggcaataatcggtatggagttaggtccatctaccatcttatctcctagcgggatggttaatattcttggtacagataaaataccagttgaggtattaaaatacggtaaagtttactggtactctaagagtgaagttaggaagaggagaaaaatgggtcatgtaaatgtagtagggaacaatcttgaagaagttaagcaaaaaattgataaaattatgcaactaatctatactaatgggttagatttatga

SEQ ID NO: 14071 - protein, 365 aa, Sulfolobus solfataricus
MFSVLDWKPKIGILGGGQLGWMIVLEGRKYPFTFYVLENDKNAPACRIADRCFSPQDYKEFVDSSDVITFEFEHVYEKALEYAEYSGKLLPRLNSVELKRERYKEKLFYRQHNLPTPRFYVAEDGEEALKILREEFNNVGVIKESKGGYDGKGQYFIFNDVEKYQFLREKKEKMVVEEYVKFDFEASIIIARDKRGVFISYPPTYNYNEKGILVYNYGPYNNQNIVEIARRLSEELDYVGIMGVEVFVVNGKVLINEFAPRVHNTGHYTLDGALISQFEQHLRAIIGMELGPSTILSPSGMVNILGTDKIPVEVLKYGKVYWYSKSEVRKRRKMGHVNVVGNNLEEVKQKIDKIMQLIYTNGLDL

SEQ ID NO: 14072 - DNA, 1167 bp, Synechocystis sp
  CDS (1)..(1167): transl_table=11
atggaaacaaaattaaccacagtgggggtaattggtggtggacagttggcctggatgatggcccaggaagccccccgattgggattaaaacttgcagtgcaaacccctggggaaagtgatccggccgtggcattggcggacaaagtggtattgacggcgatcgccgatggggaaggaactagggagttagcagagcactgtggggtgatcacctttgaaaatgaatttgtcgatctgcccagcctggaaaagttagcccaacaaggaattacttttcatccccgcctcgatgccctcgctcctttgttggataaatgggaacaacgccattttttgcaaaacctcggtttacccgtaccggatttttgggctttggaatcgttgcccgcccaattgcccgattttccctgggtgttaaaggcccgtcgccatggctatgatggccaaggaacccaaattattaattccccagcggatttaccagatttaagtaaagctccccccggtagttggatggtggagagttttgtcccctacgaaagggaattggccgttatcggtgtccgcaatgccaggggagaaatggaaatttacccagtggtggaaaccaagcaaattgaccaggtttgtcgttgggtggtggcccctgcccccattgatgccgccattgccgccacggcccaggattactgccgtcgcattctcaaccatttagattacgtgggtattttggcgatcgagttttttctattaccagcatctacccaaacccctaccccggagcaaaggttactggtaaacgagttggccccccgcacccataactctggccatttcagcttagatgcttgccacacttcccaatttgctctgcaactgcaggcggtaactgggcaaacattgggttcatcggctttgcgttgcggccaagcggtgatggtgaatttattgggctacgaagtatctacaggggattatcagcaacagttggataaactagccgctctgccccatagccacgtccattggtacggcaaaggagactgtcgtcccggtcggaagctgggccatgtgactttgttaaaccctgatgttgaatcggaaccttccactgcctgggctgaagatttggtgaaacaagtagaggcgatttggtatccggattaa

SEQ ID NO: 14073 - protein, 388 aa, Synechocystis sp
METKLTTVGVIGGGQLAWMMAQEAPRLGLKLAVQTPGESDPAVALADKVVLTAIADGEGTRELAEHCGVITFENEFVDLPSLEKLAQQGITFHPRLDALAPLLDKWEQRHFLQNLGLPVPDFWALESLPAQLPDFPWVLKARRHGYDGQGTQIINSPADLPDLSKAPPGSWMVESFVPYERELAVIGVRNARGEMEIYPVVETKQIDQVCRWVVAPAPIDAAIAATAQDYCRRILNHLDYVGILAIEFFLLPASTQTPTPEQRLLVNELAPRTHNSGHFSLDACHTSQFALQLQAVTGQTLGSSALRCGQAVMVNLLGYEVSTGDYQQQLDKLAALPHSHVHWYGKGDCRPGRKLGHVTLLNPDVESEPSTAWAEDLVKQVEAIWYPD

SEQ ID NO: 14074 - DNA, 1134 bp, Vibrio cholerae
  CDS (1)..(1134): transl_table=11
atgcgtgtgttggttctcggcgctggtcagctggcgcgcatgatgtcgctcgccggagcaccgctcaatattgaaacgatcgcttttgatgtgggtagcgaaaacattgtgcaccccttaacgcaaactgtgcttgggcatggattggagcaagcgattgaacaagtcgatgtgatcaccgctgagtttgaacacattccgcatccgatcctcgatctctgtgcacgcagtggcaaactttacccaagcgctgaagctatcaaagctggcggcgatcgtcgtttagaaaaagccttgctggatcgcgcccaagtggcgaatgcacgttatacgatgatccgcagccgagacgacctaacctcagccatcgccgagattggattgcctatggtgctgaaaagtgcactcggaggctacgatggaaaaggccaatggcgcttgaaagaaccaacgcagatcgaatcggtttggcaagaacttgcgcaatatctggcagccaaccccgaacaagcaattgtggcagaagaatttgtcgcttttgatcgcgaagtgtcactggtcggtgcacgtaacctagtcggcgatgttgtggtgtatcctttagcggagaacgttcatacccaaggtgtgttgagcctttctaccgccattgatgctcctgcgctacaaactcaagcgaaagccatgtttaaagcggtagccgagcagctcaattatgtcggtgtattagcgctggagttttttgaagtacaaggccagttactggtcaatgaaattgcaccacgagttcataactccggtcactggactcagcaaggtgcggaaacctgtcagttcgaaaaccacttacgcgcagtgtgtggcttaccgctgggtagcaccaaactggttcgtgagaccgcgatgattaatattcttggtgaagatcagctgcccgcagaagtattggcactggaaggctgccacgtacattggtacggcaaggccaagcgctcaggacgcaagatggggcatatcaatgtgaccgccgattacagtggtgagttgcaacgcaaattatgccaattagcgactgtgttagatgaaaaggcttttcctgccgtacacgccgtagcaaaggaaattcagccttaa

SEQ ID NO: 14075 - protein, 377 aa, Vibrio cholerae
MRVLVLGAGQLARMMSLAGAPLNIETIAFDVGSENIVHPLTQTVLGHGLEQAIEQVDVITAEFEHIPHPILDLCARSGKLYPSAEAIKAGGDRRLEKALLDRAQVANARYTMIRSRDDLTSAIAEIGLPMVLKSALGGYDGKGQWRLKEPTQIESVWQELAQYLAANPEQAIVAEEFVAFDREVSLVGARNLVGDVVVYPLAENVHTQGVLSLSTAIDAPALQTQAKAMFKAVAEQLNYVGVLALEFFEVQGQLLVNEIAPRVHNSGHWTQQGAETCQFENHLRAVCGLPLGSTKLVRETAMINILGEDQLPAEVLALEGCHVHWYGKAKRSGRKMGHINVTADYSGELQRKLCQLATVLDEKAFPAVHAVAKEIQP

SEQ ID NO: 14076 - DNA, 1134 bp, Vibrio parahaemolyticus
  CDS (1)..(1134): transl_table=11
atgcatgtactggttctcggatcaggtcagttggctcgcatgatgtctctggctggtgcaccactgaacatccaaatctcggcttacgatgtcggtagcggtaacgttgtccatcctcttacccaacaggtgcttggtcatggtttggaaaatgccattgaacaagtggatgcgatcaccgcagaattcgaacatattcctcacgatgtactcgacatctgtgaattaagtggcaagttcctccctagtaccgcagccatcaaagcaggcggtgaccgccgtgttgaaaaagcgctactcgataatgctggcgtgcgtaatgcaaagcactacgtgattgagacacgtgaagattttgaacgcgcaattgaacatgttggcatacctatggtgctgaaaagtgcattgggtggttacgatggtaaaggccaatggcgcttgaaagaagcggctcagatcgagacgatctgggcagaaatggcggagtgcattgcagcaacaccaactcaagccattgtggctgaggagtttgtgccatttaatcgtgaagtctctttagttggtgcgcgtggcaaagacggcagtgttgaagtttaccctctagcagaaaacgttcataccaatggcgtattgagcttatccaccgcaattgatgcgccagagctgcaagcgcaagccaaacagatgttcaccgctgtagctgacagcctgaattatgttggcgtactggcattagagttctttgatgtcgagggcacactgttagtcaatgagattgccccacgcgtacacaactctggccactggacacagcaaggtgcagaaacttgtcagtttgagaaccatctgcgcgccgtgtgcggcttgccgttaggcagcaccaaactgattcgagaaacctcaatggtgaatattcttggtgaagatacgttgccagaagcgctgctcgccatggatggttgtcacatccattggtacggcaaagagaagcgcgaagggcgcaaaatgggtcacatcaacgtatgcggagactacccaggagaattgcaccgcaggttgtgcgctctcgcggaggtcttagatccaatgatattcccagccgtgcacgagtttgcgaaacaagcacaacgctaa

SEQ ID NO: 14077 - protein, 377 aa, Vibrio parahaemolyticus
MHVLVLGSGQLARMMSLAGAPLNIQISAYDVGSGNVVHPLTQQVLGHGLENAIEQVDAITAEFEHIPHDVLDICELSGKFLPSTAAIKAGGDRRVEKALLDNAGVRNAKHYVIETREDFERAIEHVGIPMVLKSALGGYDGKGQWRLKEAAQIETIWAEMAECIAATPTQAIVAEEFVPFNREVSLVGARGKDGSVEVYPLAENVHTNGVLSLSTAIDAPELQAQAKQMFTAVADSLNYVGVLALEFFDVEGTLLVNEIAPRVHNSGHWTQQGAETCQFENHLRAVCGLPLGSTKLIRETSMVNILGEDTLPEALLAMDGCHIHWYGKEKREGRKMGHINVCGDYPGELHRRLCALAEVLDPMIFPAVHEFAKQAQR

SEQ ID NO: 14078 - DNA, 1134 bp, Vibrio vulnificus
  CDS (1)..(1134): transl_table=11
atgcacgtattggttctaggcgcagggcaattggcacgtatgatgtcgttagccggtgcgcctttgaatattcagatttctgcctacgatgtgacaacgggtgatgtcgttcatcctttgacattgcatctccttggtcacggcttggagcaagcgattgaatacgttgatgtgatcactgcagaatttgaacacattcctcatgacgtattggcgatctgccaagcgagtggcaagtttcttccaagtagtgaggcgattaaggctggcggtgatcgtcgtttggaaaaagccttgcttgaccatgcaggcgtacgcaatgccaattactacgtcattgaaacgcgtgaagacttcaataaagcgattgaacacgttgggatacctatggtgttgaaaagcgcattaggtggctatgatggtaaagggcaatggcgcttaaaagatgccgcacaaattgaaaccctttggcaagaaatggcagcttgtatcgctgctacgccaactcaagcgattgtcgctgaagaatttgttccatttcaacgtgaagtttcattgatcggcgctcgtggtaaagaagggcaaatcgaagtctacccactggcagaaaacattcacgttaatggcgtgttaagcctttcaacggcaatcgactcaccggacctacaagagcaagccaaacacatgtttactgctgttgctgaaacattgaactacgttggtgtgttggcgcttgaatttttcgatgtcgacggacaattgctggtcaatgaaattgcacctcgagttcataactccggccattggacccagcaaggagcagaaacttgccagtttgaaaatcatttgcgtgccgtttgtggcttaccacttgggagcactaagctggttcgtgaaacctcaatgatcaacatccttggtgaagatactctgcccgcaagcgtgatggcgatggacggttgtcatattcattggtatggcaaagagaaacgcgccggccgaaaaatgggccatatcaacgtgtgtggtgattacagcggagagctacagcgccgcctttgtgctctcgccaatgtattggatgagaaagccttccccgcggtgcatgagtttgcaaaaaagtggcaagcgtag

SEQ ID NO: 14079 - protein, 377 aa, Vibrio vulnificus
MHVLVLGAGQLARMMSLAGAPLNIQISAYDVTTGDVVHPLTLHLLGHGLEQAIEYVDVITAEFEHIPHDVLAICQASGKFLPSSEAIKAGGDRRLEKALLDHAGVRNANYYVIETREDFNKAIEHVGIPMVLKSALGGYDGKGQWRLKDAAQIETLWQEMAACIAATPTQAIVAEEFVPFQREVSLIGARGKEGQIEVYPLAENIHVNGVLSLSTAIDSPDLQEQAKHMFTAVAETLNYVGVLALEFFDVDGQLLVNEIAPRVHNSGHWTQQGAETCQFENHLRAVCGLPLGSTKLVRETSMINILGEDTLPASVMAMDGCHIHWYGKEKRAGRKMGHINVCGDYSGELQRRLCALANVLDEKAFPAVHEFAKKWQA

SEQ ID NO: 14080 - DNA, 1134 bp, Vibrio vulnificus
  CDS (1)..(1134): transl_table=11
atgcacgtattggttttaggcgcagggcaattggcacgtatgatgtcgttagccggtgcacctttgaatattcagatttctgcctacgatgtgacaacgggtgatgtcgttcatcctttgacattgcatctccttggccacggcttggagcaagcgattgaacacgttgatgtgatcacagcagagtttgaacacattcctcatgacatattggcgatctgccaagcgagtggcaagtttcttccaagcagtgaggcgattaaggctggcggtgatcgtcgtttggaaaaaaccttgcttgaccatgcaggcgtacgcaatgccaattactacgtcattgaaacgcgtgaagacttcaataaagcgattgaacacgttgggatacctatggtgttgaaaagcgcattaggtggctatgatggtagagggcaatggcgcttaaaagatgccgcacaaattgaaaccctttggcaagaaatggcagcttgtatcgctgctacgccaactcaagcgattgtcgctgaagaatttgttccatttcaacgtgaagtttcattgattggcgctcgtggtaaagaagggcaaatcgaagtctacccactggcagaaaacattcacgttaatggcgtgttaagcctttcaacggcaatcgactcaccggacctacaagagcaagccaaacacatgtttactgctgttgctgaaacattgaactacgttggtgtgttggcgcttgaatttttcgatgtcgacggacaattgctggtcaatgaaattgcacctcgagttcataactccggccattggacgcagcaaggagcagaaacttgccagtttgaaaatcatttgcgtgccgtttgtggcttaccacttgggagcactaagctggttcgtgaaacctcaatgatcaacatccttggtgaagatactctgcccgcaagcgtgatggcgatggatggttgccatattcattggtatggtaaagagaaacgcgccggacgaaaaatgggccacattaatgtgtgtggcgattacagcggcgagctgcagcgccgtctttgtgctctcgccaatgtgttggatgaaaaagccttccccgcggtgcatgagtttgcaaaaaagtggcaagcgtag

SEQ ID NO: 14081 - protein, 377 aa, Vibrio vulnificus
MHVLVLGAGQLARMMSLAGAPLNIQISAYDVTTGDVVHPLTLHLLGHGLEQAIEHVDVITAEFEHIPHDILAICQASGKFLPSSEAIKAGGDRRLEKTLLDHAGVRNANYYVIETREDFNKAIEHVGIPMVLKSALGGYDGRGQWRLKDAAQIETLWQEMAACIAATPTQAIVAEEFVPFQREVSLIGARGKEGQIEVYPLAENIHVNGVLSLSTAIDSPDLQEQAKHMFTAVAETLNYVGVLALEFFDVDGQLLVNEIAPRVHNSGHWTQQGAETCQFENHLRAVCGLPLGSTKLVRETSMINILGEDTLPASVMAMDGCHIHWYGKEKRAGRKMGHINVCGDYSGELQRRLCALANVLDEKAFPAVHEFAKKWQA

SEQ ID NO: 14082 - protein, 412 aa, Artificial sequence
  consensus sequence
  Variant (2)..(3): Xaa in position 2 to 3 is any amino acid
  Variant (5)..(5): Xaa in position 5 is any amino acid
  Variant (9)..(10): Xaa in position 9 to 10 is any amino acid
  Variant (12)..(12): Xaa in position 12 is any amino acid
  Variant (13)..(14): Xaa in position 13 to 14 is any or no amino acid
  Variant (16)..(19): Xaa in position 16 to 19 is any amino acid
  Variant (21)..(41): Xaa in position 21 to 41 is any amino acid
  Variant (42)..(64): Xaa in position 42 to 64 is any or no amino acid
  Variant (66)..(66): Xaa in position 66 is any amino acid
  Variant (68)..(68): Xaa in position 68 is any amino acid
  Variant (70)..(130): Xaa in position 70 to 130 is any amino acid
  Variant (131)..(167): Xaa in position 131 to 167 is any or no amino acid
  Variant (169)..(171): Xaa in position 169 to 171 is any amino acid
  Variant (172)..(172): Xaa in position 172 is any or no amino acid
  Variant (177)..(177): Xaa in position 177 is any amino acid
  Variant (179)..(197): Xaa in position 179 to 197 is any amino acid
  Variant (198)..(214): Xaa in position 198 to 214 is any or no amino acid
  Variant (216)..(222): Xaa in position 216 to 222 is any amino acid
  Variant (224)..(224): Xaa in position 224 is any amino acid
  Variant (226)..(229): Xaa in position 226 to 229 is any amino acid
  Variant (231)..(232): Xaa in position 231 to 232 is any amino acid
  Variant (233)..(233): Xaa in position 233 is any or no amino acid
  Variant (235)..(238): Xaa in position 235 to 238 is any amino acid
  Variant (239)..(239): Xaa in position 239 is any or no amino acid
  Variant (241)..(254): Xaa in position 241 to 254 is any amino acid
  Variant (255)..(256): Xaa in position 255 to 256 is any or no amino acid
  Variant (258)..(262): Xaa in position 258 to 262 is any amino acid
  Variant (263)..(271): Xaa in position 263 to 271 is any or no amino acid
  Variant (273)..(282): Xaa in position 273 to 282 is any amino acid
  Variant (284)..(286): Xaa in position 284 to 286 is any amino acid
  Variant (288)..(291): Xaa in position 288 to 291 is any amino acid
  Variant (293)..(293): Xaa in position 293 is any amino acid
  Variant (295)..(302): Xaa in position 295 to 302 is any amino acid
  Variant (303)..(311): Xaa in position 303 to 311 is any or no amino acid
  Variant (314)..(314): Xaa in position 314 is any amino acid
  Variant (318)..(318): Xaa in position 318 is any amino acid
  Variant (324)..(331): Xaa in position 324 to 331 is any amino acid
  Variant (335)..(338): Xaa in position 335 to 338 is any amino acid
  Variant (340)..(344): Xaa in position 340 to 344 is any amino acid
  Variant (346)..(355): Xaa in position 346 to 355 is any amino acid
  Variant (356)..(361): Xaa in position 356 to 361 is any or no amino acid
  Variant (363)..(363): Xaa in position 363 is any amino acid
  Variant (365)..(366): Xaa in position 365 to 366 is any amino acid
  Variant (368)..(381): Xaa in position 368 to 381 is any amino acid
  Variant (382)..(396): Xaa in position 382 to 396 is any or no amino acid
  Variant (398)..(398): Xaa in position 398 is any amino acid
  Variant (402)..(406): Xaa in position 402 to 406 is any amino acid
  Variant (407)..(407): Xaa in position 407 is any or no amino acid
  Variant (410)..(410): Xaa in position 410 is any amino acid
GXXGXGQLXXMXXXAXXXXGXXXXXXXXXXXXXXXXXXXXXXXXXXXXXXXXXXXXXXXXXXXXTXEXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXGYDGXGXXXXXXXXXXXXXXXXXXXXXXXXXXXXXXXXXXXXEXXXXXXXEXSXXXXRXXXGXXXXXPXXXXXXXXXXXXXXXXPXXXXXXXXXXXXXXAXXXXXXXXXXLXXXGXXXXEXFXXXXXXXXXXXXXXXXXNEXAPRXHNSGHXXXXXXXXSQFXXXXRXXXXXPXXXXXXXXXXXXXXXXMXNXXGXXXXXXXXXXXXXXXXXXXXXXXXXXXXXHXYGKXXXXXXRKXGH

SEQ ID NO: 14083 - protein, 24 aa, Artificial sequence
  protein pattern
  Variant (3)..(3): Xaa in position 3 is any amino acid
  Variant (7)..(7): Xaa in position 7 is Pro, Thr or Val
  Variant (13)..(13): Xaa in position 13 is any amino acid
  Variant (14)..(14): Xaa in position 14 is Ser or Thr
  Variant (15)..(17): Xaa in position 15 to 17 is any amino acid
  Variant (18)..(18): Xaa in position 18 is Ala, Cys, Gly, Ser or Thr
  Variant (19)..(20): Xaa in position 19 to 20 is any amino acid
  Variant (21)..(21): Xaa in position 21 is Cys, Asp, Gly, Asn or Ser
  Variant (23)..(23): Xaa in position 23 is Phe or Tyr
  Variant (24)..(24): Xaa in position 24 is Ala, Asp, Glu, Gly, Gln, Ser or Thr
NEXAPRXHNSGHXXXXXXXXXQXX

SEQ ID NO: 14084 - protein, 8 aa, Artificial sequence
  protein pattern
  Variant (2)..(2): Xaa in position 2 is Ala or Gly
  Variant (6)..(6): Xaa in position 6 is Ala or Gly
  Variant (7)..(7): Xaa in position 7 is any amino acid
GXGQLXXM

SEQ ID NO: 14085 - DNA, 2376 bp, Saccharomyces cerevisiae
  CDS (1)..(2376)
atggtagcgacatcttcaaagaggacgttggatccgaaggaggaacatttgcctgctgacaaaacatccactaattcaagcaacactataatatctgagttggcaacacaagagaaatccagctctagtggtactacactaaaattaatagctcttaatatcaagtccatatcagatgaagatgtgggatatatccaaaatgttgaaagactgtctttaaggaaaaatcacttaacatccttaccagcgagtttcaagaggttatcaaggctgcaatatctggatttgcataataacaattttaaagaaatcccatatattttgacacaatgccctcaattagagatcttggatctgtcctccaatgagattgaagcattgccagatgaaatatcatcgttttggcaagataatattcgtgtattatcattgaaagacaacaacgttactagcatacgtaatttgaaatcgatcacaaaattaaacaagctgagcatcttggatttagaggataataaaatacccaaagaagagcttgaccaagtacagagttatactccatttcatacgggcatccccaaagaagaatattgggcaattgcgatatcacgatatctaaaagatcatcctaacctacctactccagaacctaaaatatctagagcagcgaaaagaatgggattcataaatacgaacttgtctaatggagcaatgaatgaaaacaatataatttcacttgccccaagtgcaaatacaactataagtgcatctactgcaatggtctcatctaatcaaacctctgcaacatctttcagtggtacagtcaatgcagaatcagaacaaagtggggcagtgaatggtacggaactatacaatcacaccaaatataatgactacttcaagaggttgtcgattttaccagaagagtcaatgagtaacgggcatcaaaaaatatcgcatgcagagttggttgtttcctgtcggaagctcctatttagttttacagaatgccaacaagctatcagaaaaatcgcctctttctgtaaagagaaggccgtagcggttaatgtagtatcattattatactctgtcagatcacatactgataatctggtggaggtcttgcagcaaacagagaacgaagacgaatcgcatgatcaggcgttaatcaagctgtgcctcactatcatcacaaattttaaacaaattataacattgttgagaaaaaattttgagatttttttcaaagaagacgatctatgcttcataaggatgttttatatgacattaatgtgtgcttatatggaaatgtataatgcatggtcttttatcaaagaagatgatcaagtgtccggttctgcaagtaaggcacccaagaaacattctttttcgaggcacgagacatcgtccagtagtatcacaagcggtggaggacccgcagcaagtacgaccagtacacattgtagcggaaacataaaattactgccgaaaacaaggagcacaagaacaccatctgcatctgcattgctttcaaatagtaatattctgacgggtgataccactgctgttcctcttttatcaccaaatctaaatggtgcacacacccatggtccaattttgggacaccaaaatgcaataagcaatggaagttctcaaacgaacatgaatgaagtaaaaactactagcgatactattccaaggcaacagctgcttcagcacaataaatccatcagcgattcgaaaaaagagtcacaggcgcatgaacctaaacagcatccggttatgacttcttcaataattaacgcatcaaatagtaataacgtctcgaatgttaatataaccccaccaccgatgaatggtggtggtgccgcgaacagtagtgctaatgtagtggagacaaatattgacattcaactgtatcaaacgttgtccacagtagttaaaatggtgagcgttgtatataaccagttaacttcagagatatccaagatagccattgctagcaccatgggaaagcaaattttgacggactcgctagcacctaaaattcgtgatttgacggaaacatgtcgtcaagcgatggatttatccaaacaattgaatgaaaggttaaatgtattaataccgaacgattcaaattcagagaagtatctgacatctttggagaagctgaaaacgtgggagataatgaattcgttcttaaaagtaataatatcaattctggctaatactaaaatcgtaatgagcgacgtgcctaatttgaatgagctgagacctaacctagccaacttggcgaagattaccaaggatgtcactgtgatattggacttgagttcatacaaggctgtatcagtaagcgccaactctccggagtaa

SEQ ID NO: 14086 - protein, 791 aa, Saccharomyces cerevisiae
MVATSSKRTLDPKEEHLPADKTSTNSSNTIISELATQEKSSSSGTTLKLIALNIKSISDEDVGYIQNVERLSLRKNHLTSLPASFKRLSRLQYLDLHNNNFKEIPYILTQCPQLEILDLSSNEIEALPDEISSFWQDNIRVLSLKDNNVTSIRNLKSITKLNKLSILDLEDNKIPKEELDQVQSYTPFHTGIPKEEYWAIAISRYLKDHPNLPTPEPKISRAAKRMGFINTNLSNGAMNENNIISLAPSANTTISASTAMVSSNQTSATSFSGTVNAESEQSGAVNGTELYNHTKYNDYFKRLSILPEESMSNGHQKISHAELVVSCRKLLFSFTECQQAIRKIASFCKEKAVAVNVVSLLYSVRSHTDNLVEVLQQTENEDESHDQALIKLCLTIITNFKQIITLLRKNFEIFFKEDDLCFIRMFYMTLMCAYMEMYNAWSFIKEDDQVSGSASKAPKKHSFSRHETSSSSITSGGGPAASTTSTHCSGNIKLLPKTRSTRTPSASALLSNSNILTGDTTAVPLLSPNLNGAHTHGPILGHQNAISNGSSQTNMNEVKTTSDTIPRQQLLQHNKSISDSKKESQAHEPKQHPVMTSSIINASNSNNVSNVNITPPPMNGGGAANSSANVVETNIDIQLYQTLSTVVKMVSVVYNQLTSEISKIAIASTMGKQILTDSLAPKIRDLTETCRQAMDLSKQLNERLNVLIPNDSNSEKYLTSLEKLKTWEIMNSFLKVIISILANTKIVMSDVPNLNELRPNLANLAKITKDVTVILDLSSYKAVSVSANSPE

SEQ ID NO: 14087 - DNA, 2607 bp, Candida glabrata CBS 138
  CDS (1)..(2607)
atgccactagcaaatgaaaaatacaatgacgatagttcaaaggggtctcaagctatgaatgagttaagtatagatgaaatgagagaagtaatagatcatgagttaacacaacaggaatcaaaaaatagctccactgttaaacttataggactgaaccttaaaacaataccaccggaagatattaaactacttgcaaatgcagaaagactctcactaaggaaaaacaacataacatacttaccagaaaactttagtgagttaaaaaacctgcgctacctcgatctgcatagtaatgggcttcgagagatcccggttgaacttctgaattgccagaagttggaaattttggatatatcatccaataaaatctctcagcttccagaggaatttccaagcgtattctctactagattaaaggttatatctctgaagaacaacagacttacctcaatttggaaactatctcctattcttcaactaaatcatataaaagttctagaaattgaaggaaaccctataccgaaagaagaacttgatcaagtactatcttatgttccaaatcaacaaaacttacctaaagatgagtattgggcaattgccattcctcgctttcttaacaatcacccaaaaatgaaagtacagtcgctagagtcaaaattgagtagagcggcaaagcggatggggtttgttaataccataccagtaactgatgaacaattgaatgattctagcatctcatctgccactatatcagaacatatcaataatgttactattgccaaagagaatttcacagatacgaatatgaatacacctaatgttctgtcttcaaatgacctctacaaccatactaaatacaacgattatttcaaaagactatcaattcttccagaagaggttaaccaggaacagcataaagtatcacacactgatttggttgttgcttgtcgcaaattattgtttagttttacagagtgtcaacaggcaatacgaaagatcacttcactttgtaaagaaaagtccattgctgtgaatgtggtatctcttctatattcggttagatcacacattgataatcttgtggaaattttagaacagtctgacaatcaagaaatctcgaacgaccaacctttgatcacactttgtatgactatcatctcaatatttaaacaaattattgcgctgttacagaaaaattttaaagctttttttgaggaagatgatttatgtttcataagaatgtttttcatgtcactagtgtgttcatatactgaaatgtacaatgcatggagctttattacaccacaggagacacttttactacataagaaaagtgccagtaacaatagcaataaaattcaacctgagagtgatggtcatccggctataataagaagtaaaagcgaagcgaacagtaggacagaccatgtcggattaagcagaaaaccaacgctaactaatgtttcaaaaccagatattgctggagtacgattgtcaaatgaagaaaaaactagatatcatgatgccgtatctgatcaagaaagctcagtagaacacaatgaatcaggcattccaaaagtagccaggtcaagaagtaataccatacaaggtagaggaacaggtagtcttttgaatgttaatggatctaagtctaatataataacatctcctaatggtgttagtcagttacgaactcaaggacaactacctactcatgcagttgctactacaaacagtactcaagagcaaggttcttcggacaaacataaaatgaatatttctaatttagctaagacagcagataatagaggtggtaatttcaagaatccacctgatgagaaacagattaacaatgaacttcaaaatggaaatgtgtctcttacagcaccaaaactaaagcaagtacagcaacccccattaactgagaagggtggaatctcaacaccgactggaacggatgtagatattgatcagcaacttcacgaaacattgggaacagtagttaagatggtgacaatggtgtataatcaacttacatctgaaatatctaaagttgctttggctagttcaacaggacatcaggtattgaccgatacactagctaccaaaataaaagatttaacagatacctgtaggcaattattgcaattatcacaggtactaggtgaaaggttacggcttctgactggtgatggaataactgctgaaaagtattcaacgacctctgaaaagctaaaaacatgggaaagtatcaatgccttcctcaaagcaattatttcaattcttgccaatgcaaagactttaatggctgatttgccaagtctaaatgaagtaaggccacaacttgcttcgttagccaagataaccaaagatgttacggtgattttagatttgagttcatataaagcagtttctgttgcagcagcaaatcaagaagctctacagcataacaataacaactctgaaacaaaatctggagattccaaatcgccagtaaacgaatcggctataagtggtgatcacagtcatacagacatcgccaatgttccactgtttacaccacaggctgctagtgcttatatgagggatccattcgaccaacagtaa

SEQ ID NO: 14088 - protein, 868 aa, Candida glabrata CBS 138
MPLANEKYNDDSSKGSQAMNELSIDEMREVIDHELTQQESKNSSTVKLIGLNLKTIPPEDIKLLANAERLSLRKNNITYLPENFSELKNLRYLDLHSNGLREIPVELLNCQKLEILDISSNKISQLPEEFPSVFSTRLKVISLKNNRLTSIWKLSPILQLNHIKVLEIEGNPIPKEELDQVLSYVPNQQNLPKDEYWAIAIPRFLNNHPKMKVQSLESKLSRAAKRMGFVNTIPVTDEQLNDSSISSATISEHINNVTIAKENFTDTNMNTPNVLSSNDLYNHTKYNDYFKRLSILPEEVNQEQHKVSHTDLVVACRKLLFSFTECQQAIRKITSLCKEKSIAVNVVSLLYSVRSHIDNLVEILEQSDNQEISNDQPLITLCMTIISIFKQIIALLQKNFKAFFEEDDLCFIRMFFMSLVCSYTEMYNAWSFITPQETLLLHKKSASNNSNKIQPESDGHPAIIRSKSEANSRTDHVGLSRKPTLTNVSKPDIAGVRLSNEEKTRYHDAVSDQESSVEHNESGIPKVARSRSNTIQGRGTGSLLNVNGSKSNIITSPNGVSQLRTQGQLPTHAVATTNSTQEQGSSDKHKMNISNLAKTADNRGGNFKNPPDEKQINNELQNGNVSLTAPKLKQVQQPPLTEKGGISTPTGTDVDIDQQLHETLGTVVKMVTMVYNQLTSEISKVALASSTGHQVLTDTLATKIKDLTDTCRQLLQLSQVLGERLRLLTGDGITAEKYSTTSEKLKTWESINAFLKAIISILANAKTLMADLPSLNEVRPQLASLAKITKDVTVILDLSSYKAVSVAAANQEALQHNNNNSETKSGDSKSPVNESAISGDHSHTDIANVPLFTPQAASAYMRDPFDQQ

SEQ ID NO: 14089 - DNA, 2379 bp, Kluyveromyces lactis NRRL Y-1140
  CDS (1)..(2379)
atggataaccatacggaattactgacatcactcaggcaaggtcaaaatggaaatcccccgatgcaccctgttaataaagagatttatcagaaggataacacagcagtttcattagctgatcttggtttgtcttcaataacagatgatgctgttgagctgcttcaactagttgagaacctttctttgcaccagaataacttaacacagcttcccggatcctttaaaaagttgacaaatcttcgaaccatcgatctttctgataacagattcaatgatattcctccatcgttaatgcaatgccttcgattagaaaaaataaatctttctaacaacaacatatggcagctacctcaagaatttccagagacatggtgtgataaccttgttacactctcattgaggaacaacaatctaacatccatcaagacactatttcctataatatcccagttaaagaatctacgagtccttgaactagatgggaataattttccaaatgatgttatcgagaaggttctacaaggttttactagttccaagtgctctgcggaagaatactgggttatagccttaagaaaattcttcagtgacaataccgtttcacaaacaccggcagttacaactctggatccacaacaaaagatagcaagggctgcgaaacgaatgggctttattggaaattcacatgattcggaagacaatgagaataatctcacgtctccccagagcgatcttgatctttactctcattcaaaattcaacgaatacttcaaaagattatctgttctgccagaggaacccaatttgcaagaggtagaagaggaaacagatgaacagaattataaagaattactacagacacatcatgaaaagaaaagaaaatctatggaaaatgttgtgctagcttgcaggaaacttttgttcactttcactgagtgtcagcaaaacattaggaagataacatcgctatgttctgaaaagaccatttcggttaatgttgtgtcacagctttacagtctcaagtctcatattgataatttagttgaagtcttggaacaatttgaaaataatagtcaacaaaatgatccttcaataacgcaaagtcagttccttcatcatgatgttttgatacgactatgtttgaccatactttctatattcaaaaagatttttgttcaacttcgaaagaacttcactgcattttttggcaataacgacgtgttttttttaagggtgttctacatgaacatattatgttcgtatactgaaatattcaacgcctggaaactacttgttttggataaccaggaaatgatgaaaaagaaaaagctagccagaacgcattcagttcattctatgaacatggctcagtaccaaaagtatttaaacagcaggcaaaaatcgtcttctgctattaatcgatcttcttctctgagtggcgtctcttcccaacagtctgcaattaatgtcaacacaccaggtataaatggtccttatgcgaatcaaaatggccaacaggttaccccgccaattaatccaacatctttcacgactacaccgatatctgaagtttcaacaacaccgcctatactagattcttcaccgaaaccacctcgcagtctaaattacagtgagcaatcaactgcctccacagtcacacaaggtgccgcacccaccgatacctccaatatcccctcacaagcacttgcagataaggatatagacctgcagctataccatacgttgaatacagttattgatatggttaacgttgtatattcacaattgacgcaggcaataacaaagtcagcaatagctagtactacctccgatcagctttcaataactcctacggttgctgcaaaaacaaaagaattgacagatacttgcttccaatccatggagttatcgaaagtgttaaaaaaacgactaaatgtgatttccaatagtgatattgacacatatttggttactaaagaaaagctcaaaacttgggaagatataaatgcatttttgaagtcaatcatagctattctagccaacacaaaggaaatcatgagtgatctgccgactttgaatgacgtgaggcctaatctagcctctttagctaaaattacaaaggatgttactgttatactcgatctaagctcttacaaaagtgcttccattaccaatcagcagtcatcctcaaacccttcatatgttggtgcaagttctgttgatgcgccatcacaacagcaaaatcacacaacgaatcaaggatcaccggcaggtcagcatggagataccacggatcatacagcttcgaatataataacaccattatctacgccttcgctggtgacttctcacaatgtgaatccatttgatcaactgtga

SEQ ID NO: 14090 - protein, 792 aa, Kluyveromyces lactis NRRL Y-1140
MDNHTELLTSLRQGQNGNPPMHPVNKEIYQKDNTAVSLADLGLSSITDDAVELLQLVENLSLHQNNLTQLPGSFKKLTNLRTIDLSDNRFNDIPPSLMQCLRLEKINLSNNNIWQLPQEFPETWCDNLVTLSLRNNNLTSIKTLFPIISQLKNLRVLELDGNNFPNDVIEKVLQGFTSSKCSAEEYWVIALRKFFSDNTVSQTPAVTTLDPQQKIARAAKRMGFIGNSHDSEDNENNLTSPQSDLDLYSHSKFNEYFKRLSVLPEEPNLQEVEEETDEQNYKELLQTHHEKKRKSMENVVLACRKLLFTFTECQQNIRKITSLCSEKTISVNVVSQLYSLKSHIDNLVEVLEQFENNSQQNDPSITQSQFLHHDVLIRLCLTILSIFKKIFVQLRKNFTAFFGNNDVFFLRVFYMNILCSYTEIFNAWKLLVLDNQEMMKKKKLARTHSVHSMNMAQYQKYLNSRQKSSSAINRSSSLSGVSSQQSAINVNTPGINGPYANQNGQQVTPPINPTSFTTTPISEVSTTPPILDSSPKPPRSLNYSEQSTASTVTQGAAPTDTSNIPSQALADKDIDLQLYHTLNTVIDMVNVVYSQLTQAITKSAIASTTSDQLSITPTVAAKTKELTDTCFQSMELSKVLKKRLNVISNSDIDTYLVTKEKLKTWEDINAFLKSIIAILANTKEIMSDLPTLNDVRPNLASLAKITKDVTVILDLSSYKSASITNQQSSSNPSYVGASSVDAPSQQQNHTTNQGSPAGQHGDTTDHTASNIITPLSTPSLVTSHNVNPFDQL

SEQ ID NO: 14091 - DNA, 24 bp, Artificial sequence
  primer
atggtagcgacatcttcaaagagg

SEQ ID NO: 14092 - DNA, 23 bp, Artificial sequence
  primer
ttactccggagagttggcgctta

SEQ ID NO: 14093 - DNA, 2598 bp, Saccharomyces cerevisiae
  CDS (1)..(2598)
atgtcgtacaccaataaacgtcatacatactacggagggtttaccaacgatttgtctgacacatttcagtaccctcaaagaacagatgagcaaaggcggaaacatgtaacgtttggtccttatatcctagggtcgacgttaggagaaggagagttcggaaaagtgaagctaggctggccaaagaatttttcaaacagctctaattcaacttttgacttcccaaaacaagtagcaattaaacttatcaaacgtgatagcatatcgaatgattacaggaaagaagttaaaatatacagagaaatcaacgccttaaaacacttatcacatccgaatatcgtaaaattagaagaagtgttgcaaaattctaggtacattggtattgtcctagagtacgcatgcgggggagaattctataaatatattcaaaaaaaaaggaggcttaaggaaatgaatgcatgcaggttattttctcagctaataagtggagtacattacatacattctaagggacttgttcacagagatctcaaattggaaaatctattactagacaagaatgagaacctagttattacagattttgggtttgtcaatgagttttgctcacgaaacgaattaatgaagacgtcatgtggctctccatgctacgcagcgcctgaactagtgataagcgccgaaccatacgaagctagaaaagcagatatatggtcatgtggagttatactttacgctatactagctggatatttaccgtgggatgatgatccaaataatcctgaaggcagcgatataggaagactttataattatattaactccacaccattaaagttccctgattatattcttcctatacctcgggacttattaagacgcatgctggtctcagacccaaagaaaagaataaacctgaaacagatcaagaaacatgaatggctaaagcctcattcttcattcttatccataacacctgatgagtgggacaaactaaacaatactcaatccgtgttcagattagcaaaaccaagaagaagatatggatctagaccacaatccagttgttctacctcatctcttggctcaaggagtgataaaagggattcactggtcattgattcaactttaattactttcccggctccgcctcaagaatcacaaaatcatattataaccagaccggcttctattgcatctgaccagcggctgtcacctataagaagatctaataggcacaatagaagtaactctgctgcatccgttgccttgcaggcagtggtgaacgcagatagggaatatgtgttaagtcatgaacaatcattatccccagtacaaaacattagacaaactacgggaaacatgactgccagtctttcacctccaccagccataagtccaggcgatattataatcgaaaccacacctattaaaagaaatacaatttctgggagtagtattgtaccaagtttagaagaagagtcgtctaccacaatgcaaacaagcaagattcaaccaaataacatggcttcatcacaaaatcatcaatacaataaaaataagacccaaaatagtctccaatctgctaaaaatttctaccgtacgtcttcctcatcccatacaaagccacggccaacttcataccatcctggctcatacacaacacctccctacaattcaaatacgctctccatatatgagatcaacgaaaaagctaaaagtagcgcttcatcacaaacgctgaatcaaagagacacatccccatttgattccacaccataccttgccctagatacatgcataacctcatcctcttccatcgaaagctctccaaagttaattacgcacggccaattttcagtagcaaaaccctctgttgatttgcaaagcgtatctggtgacttgatcaagtataagagggacgctgatgtagtaacgagaatctatgatgaaaaatacaaacagaagcgcaaaagtttgagatatagcggcatattcagtgacatctcatgcgatacggtcaccgaagagtctgatgaattgaggccaccagaatctcctcttcaacaacatgaaggacaagaatcaattgataaggcgaaaacggaggacacaagtgaaaagggtagtaaaagtagcaacatcgcgaaagctacagcacaaaaacacgtcaataaccatctagaaagatcacttaacgaagcagagtcaacaaagaaaagatttagctttctttccttgtactcttatgatacttccaaatctagtttatactcatcaatggattccaaacggaaaccttctccaccttcccaaagacgcccaaaaaaggatgacagttatcaaacaaattcaaagaatcattatatcactgcttcaaatatgcaaacatcccatcaagtctcaaaagacctgcctgcaccaacgatggtgcaaaataaatgtactttagaaactaaaaaagcggtccgaagcaacaggtcctccataatggtatctgaggtcaacaaggcaagcgtagacaataaagcagcccaaagtccagaacattcaaccgcaaaaagagtattagggtttttcaaaagaagaagtatgaaaatctag

SEQ ID NO: 14094 - protein, 865 aa, Saccharomyces cerevisiae
MSYTNKRHTYYGGFTNDLSDTFQYPQRTDEQRRKHVTFGPYILGSTLGEGEFGKVKLGWPKNFSNSSNSTFDFPKQVAIKLIKRDSISNDYRKEVKIYREINALKHLSHPNIVKLEEVLQNSRYIGIVLEYACGGEFYKYIQKKRRLKEMNACRLFSQLISGVHYIHSKGLVHRDLKLENLLLDKNENLVITDFGFVNEFCSRNELMKTSCGSPCYAAPELVISAEPYEARKADIWSCGVILYAILAGYLPWDDDPNNPEGSDIGRLYNYINSTPLKFPDYILPIPRDLLRRMLVSDPKKRINLKQIKKHEWLKPHSSFLSITPDEWDKLNNTQSVFRLAKPRRRYGSRPQSSCSTSSLGSRSDKRDSLVIDSTLITFPAPPQESQNHIITRPASIASDQRLSPIRRSNRHNRSNSAASVALQAVVNADREYVLSHEQSLSPVQNIRQTTGNMTASLSPPPAISPGDIIIETTPIKRNTISGSSIVPSLEEESSTTMQTSKIQPNNMASSQNHQYNKNKTQNSLQSAKNFYRTSSSSHTKPRPTSYHPGSYTTPPYNSNTLSIYEINEKAKSSASSQTLNQRDTSPFDSTPYLALDTCITSSSSIESSPKLITHGQFSVAKPSVDLQSVSGDLIKYKRDADVVTRIYDEKYKQKRKSLRYSGIFSDISCDTVTEESDELRPPESPLQQHEGQESIDKAKTEDTSEKGSKSSNIAKATAQKHVNNHLERSLNEAESTKKRFSFLSLYSYDTSKSSLYSSMDSKRKPSPPSQRRPKKDDSYQTNSKNHYITASNMQTSHQVSKDLPAPTMVQNKCTLETKKAVRSNRSSIMVSEVNKASVDNKAAQSPEHSTAKRVLGFFKRRSMKI

SEQ ID NO: 14095 - DNA, 2271 bp, Candida glabrata CBS 138
  CDS (1)..(2271)
atgactgccagcaaaagacatacatattatggaggcggaagcatatcatatgaaagaaccaataatagtgaacatgataagacacaacgaccccaggaccatcaagggccgaaacatcgcaaacatgtaacgttcggaccctatgtcatcggggccacacttggagagggagagtttggaaaagtaaaacttgcctggtcgaaatcggcataccaacagtgtgataacactgaaggtaatgccggaaacaagccaatgactttcaaagttcctaagcaagtagcgatcaaattgatcaaacgtgatttcataacaaaggacccttcaaaagaaacaaaaatatacagagaaattaacgcactaaagcatttatcacatccaaatattgtcaaactcgaagaagttctacaaaactcaaaatatataggaattgttctagaatatgccgctggaggtgaattctacaagtttattcaaaggaagaggagattaaaagagaaccacgcttgccgattattctctcaattgataagtgctgtgcactacatacactctaaaggactggtccatagagatttgaaacttgaaaacttattgctggacaatgaggaaaacttaataattactgattttggttttgttaacgaatttctacgacagaacggtatgatgaaaacatcatgcggatctccatgctatgctgcaccagaattggttgtttcaaacaggccttacgatgcaagaaaagctgatacgtggtcttgtggaattatcttgtttgctatgcttgctggttacttgccttgggatgatgatccaaaaaatccagatggccacgatatatcaaggttatacaattacattctcaatacccctctgaagtttccagaatacatcaatcctgtacctagggatttactgagaaaaatacttgtcatagatccaaagaagagaataaacataaggtcaatagaaaagcacccatggttagagtctcactcgacattcttgtcaataaccccagatgaatgggacagactttctaatacgaaaaatatatacagaaaatctaaaccccaattttatcccaacaagaggcctggctcaacttattccaactattcttctggttcaaaagacaataagcgtgactctttaattattgattcagccttggtgagcttaccagtaccaccaaaagaattccaatctcatattttggcacgcccttcttctttagttgtagaaagccgatattctccactcggtaaacgaaatggccataatagaagcaactcagcggcatctgctgctttacaggcagtatttgatgcaagtgagagagaatccttgaagagtgttgattcaaaaccaaggtctagaagtaatgaccataaagatattattgaaggcatacagcctcagaaacatgcgtttgtaaagccatctagaaaggtacgtccaacttctatgcaagcgcctggatcttcttacattcaccatggaaactttgaaggtcttcatgagctaatgaaaagagacaatagtacagcttcttctcatcaaacttcgatatcttctgaggctcgtatcttcgatgcttcaccaactttaatacccgatctaacaaagtctccaagctcctcaacgggtaactcaccaaaacttctcccaaggaaatccttcactgtcagcaagcctttattggacttaaaatttgcctctgcagatatcatcaaagctaatgagagcacagattcactttcaaagcgtatccatgaccaaatatatgaagtagagcatccaagacaaagaagacatagctatagatacagtgggattattagcgatttgatatttgggacattatcagaagaaggtgagataaacacatttgagaataaggatcataaatcagatgctgaagaatcagaaatgacaatttcagaatcaaaactagattctgtttcaatatgctcgcaacaaagtaatatacaccggaacattagcaaacaagcaagctctgttagcctgctgaggacaacaagtaaccacagcacgaataatctaaatgtgggatctcgtacctacggaagggcggagttatatgataagagacatttgaggcaaataccttcaaatacactaaatcagattaatgcaccgggcaacactcatagaaactccgctatatattctgaagacgacaaaaggaaatctactgcgaagcgagtatttgaattttttaaaagaagaagtatgagagtttaa

SEQ ID NO: 14096 - protein, 756 aa, Candida glabrata CBS 138
MTASKRHTYYGGGSISYERTNNSEHDKTQRPQDHQGPKHRKHVTFGPYVIGATLGEGEFGKVKLAWSKSAYQQCDNTEGNAGNKPMTFKVPKQVAIKLIKRDFITKDPSKETKIYREINALKHLSHPNIVKLEEVLQNSKYIGIVLEYAAGGEFYKFIQRKRRLKENHACRLFSQLISAVHYIHSKGLVHRDLKLENLLLDNEENLIITDFGFVNEFLRQNGMMKTSCGSPCYAAPELVVSNRPYDARKADTWSCGIILFAMLAGYLPWDDDPKNPDGHDISRLYNYILNTPLKFPEYINPVPRDLLRKILVIDPKKRINIRSIEKHPWLESHSTFLSITPDEWDRLSNTKNIYRKSKPQFYPNKRPGSTYSNYSSGSKDNKRDSLIIDSALVSLPVPPKEFQSHILARPSSLVVESRYSPLGKRNGHNRSNSAASAALQAVFDASERESLKSVDSKPRSRSNDHKDIIEGIQPQKHAFVKPSRKVRPTSMQAPGSSYIHHGNFEGLHELMKRDNSTASSHQTSISSEARIFDASPTLIPDLTKSPSSSTGNSPKLLPRKSFTVSKPLLDLKFASADIIKANESTDSLSKRIHDQIYEVEHPRQRRHSYRYSGIISDLIFGTLSEEGEINTFENKDHKSDAEESEMTISESKLDSVSICSQQSNIHRNISKQASSVSLLRTTSNHSTNNLNVGSRTYGRAELYDKRHLRQIPSNTLNQINAPGNTHRNSAIYSEDDKRKSTAKRVFEFFKRRSMRV

SEQ ID NO: 14097 - DNA, 2730 bp, Kluyveromyces lactis NRRL Y-1140
  CDS (1)..(2730)
atgtctacagaagcgcatcgtcacacctattacggtggacccaccaccaacacggagtcctctcatcatattcatacgagtcatgctcataactgttccaatggtagcagccgtcgacatagctcttcgcataacggtcgaagacggcaggtaacgtttggtccttacatcatcggtccgactttaggagaaggtgaatttgggaaagtcaagctagggtggtctaaaagcaattcggatgagtctaagaatgttgccattaagctgataagaagggatacgatccccaagaactctgagaaagaagtaaagatctatagagaaatcaacgcactaaaacacttggcgcatccaaatatagtaactttggaagaagtgttacaaaattcgaaatacatcggaatagtgttgcattacgcctcgggaggtgaattctacaaatatattcaaaagaagagaagactgaaagaacctgcagcatgccggttatttgcacagttaattagtggggtacattatatgcatcataaaggattggcacatagggatttgaaattagagaacctcttattggatgaacatgagaatttaataataacagattttggatttgtcaatgagttcagttctaggaacgatttgatgaaaacatcttgtgggtctccatgttacgctgctccagaattggtcgttactacaaaggcttacgaagcaagaaaggctgacgtttggtcatgtggggtaattttgtacgctatgctagctggatatctcccgtgggatgatgatccagataatcctgacggggatgatattgcaaaactatacaattatatcacaaagacgtcattgaaatttccggaatatatcaatccgattcccagagatattttgagaagaattcttgtatcggacccttccaagcgtatcactgttgaattgatcctaaaacatcaatggctgcaaccacacgcattattcctatctttgaaaccagaggattgggatattaaggcaaaggccgaaataagtaacatcttcaggcccccaccttcacaatcttcacaatctgcatattccagaccacactcaaattcttctgtatcttcaagtgaaaaacgtaattcgctgatcatagactccactctacatctgcaacctgtgcctcctcatgaatcacaatcacatgccattgccaaaccatcttctccatcgtcggatcttagatcaagcccaattaaaagagtcaatcactcaagaagcaactctgcagcatccatcgcattgcaagctgtcgtggatgcagaaagagaattcttccagtcatctcaatcaattttacaaattagtggcgtacaatccattgaacaatctcctaatactagagttcaaacgtatactgctacgagatcgttggcacataataattcctcatccttaatgaacagaaatagtataatcgttgaggtaagcccaaacaaggaggttatatcgtcatcatcctcatctgctataccgggaatgagttattccgcatccagagagtcatatatctcaacttctcccgttagaaatgcagcacagtcgccaaaattcgttccaggttctttcacttcgaataccagtcaccataataacaaatttggctcatcacagcagtctaggcccagacccacttcatatcatccaatatcatcatcatatttagaaatgcagccttctaattctcagaataactttatcacaaccactaacgagttttcttatattccaagaacagtcaatgcaaataactacatcgactctactcgcgcaatctctcctgaattgaacggaagaactgttgatggcacttccccgccattaaactcaagaaatttccagtcaggaatcatacgcaggggatcattttctgcaagcaaaccttcaccatcagtcgatctgaataatgtagaaggggaccttattaaaaccgatgcagaggatcataagaaactcaaacagcagcgtaggaaatctcaaagatacagtactgttattttagacaattcgattgccactgtacaagaagaaactgaggaaccaattacggcttacgatgcgaacattaaaaaacccgttgaaaattccaataacttgaccaaggaattcggaaagattgttattaatgaacctcgaaaggaagatgctcacattcctatcagcaaaccggagagcgaacacctacagaaacccccacaacaacatcaatcacaagcctcgatagcaagagcagactcacattccaagaaagagaaaaggttcagtttactatccttttactcatactataataattcaaagacgagtgtcagctccgactcttctggcggaagaagagtatctgcaaattcacagaaaacaaatgaaagaatttcttctgttaaatcgaatggtataccgtctagaaacgtatcggggtcgataaatcaattcgaaacatcaaaaccgagagtatcatcgaatccatcaaacagaacaaattacagacattcgatgttacctccaaagagttctcaagttatagacgcatctgccaaacgtatgaatcgttcttctgtaatggtttcttctgccaaagatataaccagttctgatggtaccgcaagtaaagaacataaagaacaacgtgaaccaagcactgccaaaagagtctttgatttcttcaagaggagaagtatgagagtataa

SEQ ID NO: 14098 - protein, 909 aa, Kluyveromyces lactis NRRL Y-1140
MSTEAHRHTYYGGPTTNTESSHHIHTSHAHNCSNGSSRRHSSSHNGRRRQVTFGPYIIGPTLGEGEFGKVKLGWSKSNSDESKNVAIKLIRRDTIPKNSEKEVKIYREINALKHLAHPNIVTLEEVLQNSKYIGIVLHYASGGEFYKYIQKKRRLKEPAACRLFAQLISGVHYMHHKGLAHRDLKLENLLLDEHENLIITDFGFVNEFSSRNDLMKTSCGSPCYAAPELVVTTKAYEARKADVWSCGVILYAMLAGYLPWDDDPDNPDGDDIAKLYNYITKTSLKFPEYINPIPRDILRRILVSDPSKRITVELILKHQWLQPHALFLSLKPEDWDIKAKAEISNIFRPPPSQSSQSAYSRPHSNSSVSSSEKRNSLIIDSTLHLQPVPPHESQSHAIAKPSSPSSDLRSSPIKRVNHSRSNSAASIALQAVVDAEREFFQSSQSILQISGVQSIEQSPNTRVQTYTATRSLAHNNSSSLMNRNSIIVEVSPNKEVISSSSSSAIPGMSYSASRESYISTSPVRNAAQSPKFVPGSFTSNTSHHNNKFGSSQQSRPRPTSYHPISSSYLEMQPSNSQNNFITTTNEFSYIPRTVNANNYIDSTRAISPELNGRTVDGTSPPLNSRNFQSGIIRRGSFSASKPSPSVDLNNVEGDLIKTDAEDHKKLKQQRRKSQRYSTVILDNSIATVQEETEEPITAYDANIKKPVENSNNLTKEFGKIVINEPRKEDAHIPISKPESEHLQKPPQQHQSQASIARADSHSKKEKRFSLLSFYSYYNNSKTSVSSDSSGGRRVSANSQKTNERISSVKSNGIPSRNVSGSINQFETSKPRVSSNPSNRTNYRHSMLPPKSSQVIDASAKRMNRSSVMVSSAKDITSSDGTASKEHKEQREPSTAKRVFDFFKRRSMRV

SEQ ID NO: 14099 - DNA, 2403 bp, Saccharomyces cerevisiae
  CDS (1)..(2403)
atggcttctgtacctaaacgccatacatacggtggcaacgttgtcactgatagggaccgtcattctcttcaaagaaacaatgagattttgcatcctatacataaaaatcagcgaaaacatgctaccttcggaccatacataatcggttccactttgggtgagggagaatttggtaaagttaagctgggttggaccaaggcttcctcctcgaacgaggttcctaagcaagtggcaatcaaattaattagaagagatacaatcaagaaagatgccgataaagaaattaaaatataccgcgaaattaacgcactgaagcatttaactcatcctaacattatctatttagaagaggtcctgcagaattcgaaatacattggaatagtgctagagtttgtatctgggggagaattctataagtatattcaacgtaagaggagattaaaggaatcttctgcatgcagattgtttgcccaattaattagtggggtcaattatatgcactacaaaggacttgttcatagggacttaaaactggaaaatttattattagataagcacgaaaatttagtcatcacggattttggttttgtgaatgaattttttgaagataacgaattaatgaaaacttcttgtggttcgccctgttatgcagcaccagaactagttgttagtaccaaggcatatgaagcaagaaaggcagatgtttggtcgtgtggtgttattctttatgcaatgctcgctggatatttgccgtgggatgacgatcatgaaaatccaacgggtgacgatattgctagactgtacaaatacatcacgcaaacacctcttaaatttcccgaatatataacccctattccaagagatttgctgaggcgaatactggtacccaatccaagaagaagaataaacttacaaacaataaaaaggcatgtgtggttgaagcctcatgaagcgtttttgagcattcagccgaactattgggatgaacacttacagaaggaacgtccgaaaccgccaaacaaaggtgacgttggtcgccactcaacttattcttcatcagcatcttcgtactcaaaaagtagggatagaaactctttaattatagagtcgactctagagcaacatcgaatgtctccacagcttgcgaccagcagaccagcatcaccaacattctctactggttccaaagtggtgttaaacgatacgaaaaatgacatgaaagaatctaatataaatggcgagcgtactagtgcatcatgcaggtacacacgtgattcgaagggcaacggccagacccaaatagaacaagtatcagctagacactcatccagaggcaataagcacacatcggtcgcgggactcgtaacaatccctggctcccccacaactgcaagaacaaggaatgcaccatcatcaaagcttactgagcatgtaaaagattctagtcagacaagctttactcaggaggaattccaccgtattggtaattatcacgtgcctcgcagtagacctaggccaacttcatattatcctggactcagtcgtaacaccgcggataatagtttagcggatattccagtaaataagttgggttcgaatggtaggttgacagatgccaaagacccggtaccgttgaacgcaatacacgataccaacaaagctacaatctccaacaattccattatgctattatcagaaggtccggctgcaaagacttccccagtagattaccattatgctattggcgacttaaaccatggtgacaaacccataactgaggttatcgacaaaattaataaggaccttactcataaagcagctgaaaatggttttcctcgagagagcatcgacccagagagtacctcaacgatattagttacgaaagaacccactaactccaccgatgaagatcatgtagaatctcagctggagaatgttggccactcttctaataaatcagacgcttcttctgataaagatagtaaaaagatctacgaaaaaaaaaggttcagcttcatgtcgttgtactcatccttaaatggttcaagatccactgttgaatctcgtacctcaaaagggaatgcacctcctgtttcatctagaaatccatcaggacaatcgaatagaagtaacattaaaataactcagcagcaaccacgtaacctttccgacagagttccaaatcccgataagaaaattaatgataatagaataagagacaacgcacctagctatgctgaaagcgagaatccgggaaggtctgtacgggcttctgttatggtgtcaacactacgagaagaaaatcgatcggaattgtcgaatgaagggaataatgtcgaggcacagacttcaacagcaagaaaggttctgaattttttcaaaagaaggagcatgagggtttga

SEQ ID NO: 14100 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 14101 - DNA, 25 bp, Artificial sequence
  primer
atgtcgtacaccaataaacgtcata

SEQ ID NO: 14102 - DNA, 27 bp, Artificial sequence
  primer
ctagattttcatacttcttcttttgaa

SEQ ID NO: 14103 - protein, 937 aa, Artificial sequence
  consensus sequence
  Variant (2)..(5): Xaa in position 2 to 5 is any amino acid
  Variant (6)..(6): Xaa in position 6 is any or no amino acid
  Variant (11)..(11): Xaa in position 11 is any amino acid
  Variant (13)..(32): Xaa in position 13 to 32 is any amino acid
  Variant (33)..(47): Xaa in position 33 to 47 is any or no amino acid
  Variant (49)..(51): Xaa in position 49 to 51 is any amino acid
  Variant (57)..(58): Xaa in position 57 to 58 is any amino acid
  Variant (60)..(60): Xaa in position 60 is any amino acid
  Variant (73)..(73): Xaa in position 73 is any amino acid
  Variant (75)..(75): Xaa in position 75 is any amino acid
  Variant (77)..(82): Xaa in position 77 to 82 is any amino acid
  Variant (83)..(99): Xaa in position 83 to 99 is any or no amino acid
  Variant (101)..(101): Xaa in position 101 is any amino acid
  Variant (108)..(108): Xaa in position 108 is any amino acid
  Variant (111)..(111): Xaa in position 111 is any amino acid
  Variant (113)..(117): Xaa in position 113 to 117 is any amino acid
  Variant (120)..(120): Xaa in position 120 is any amino acid
  Variant (133)..(133): Xaa in position 133 is any amino acid
  Variant (138)..(139): Xaa in position 138 to 139 is any amino acid
  Variant (148)..(148): Xaa in position 148 is any amino acid
  Variant (155)..(158): Xaa in position 155 to 158 is any amino acid
  Variant (165)..(165): Xaa in position 165 is any amino acid
  Variant (168)..(168): Xaa in position 168 is any amino acid
  Variant (175)..(176): Xaa in position 175 to 176 is any amino acid
  Variant (182)..(182): Xaa in position 182 is any amino acid
  Variant (187)..(187): Xaa in position 187 is any amino acid
  Variant (189)..(189): Xaa in position 189 is any amino acid
  Variant (191)..(191): Xaa in position 191 is any amino acid
  Variant (193)..(193): Xaa in position 193 is any amino acid
  Variant (197)..(197): Xaa in position 197 is any amino acid
  Variant (210)..(211): Xaa in position 210 to 211 is any amino acid
  Variant (215)..(215): Xaa in position 215 is any amino acid
  Variant (226)..(228): Xaa in position 226 to 228 is any amino acid
  Variant (230)..(231): Xaa in position 230 to 231 is any amino acid
  Variant (248)..(252): Xaa in position 248 to 252 is any amino acid
  Variant (254)..(254): Xaa in position 254 is any amino acid
  Variant (260)..(260): Xaa in position 260 is any amino acid
  Variant (265)..(265): Xaa in position 265 is any amino acid
  Variant (268)..(268): Xaa in position 268 is any amino acid
  Variant (270)..(270): Xaa in position 270 is any amino acid
  Variant (281)..(282): Xaa in position 281 to 282 is any amino acid
  Variant (285)..(285): Xaa in position 285 is any amino acid
  Variant (287)..(287): Xaa in position 287 is any amino acid
  Variant (290)..(291): Xaa in position 290 to 291 is any amino acid
  Variant (294)..(294): Xaa in position 294 is any amino acid
  Variant (297)..(298): Xaa in position 297 to 298 is any amino acid
  Variant (300)..(300): Xaa in position 300 is any amino acid
  Variant (305)..(305): Xaa in position 305 is any amino acid
  Variant (308)..(308): Xaa in position 308 is any amino acid
  Variant (310)..(310): Xaa in position 310 is any amino acid
  Variant (314)..(314): Xaa in position 314 is any amino acid
  Variant (317)..(318): Xaa in position 317 to 318 is any amino acid
  Variant (321)..(322): Xaa in position 321 to 322 is any amino acid
  Variant (324)..(325): Xaa in position 324 to 325 is any amino acid
  Variant (328)..(331): Xaa in position 328 to 331 is any amino acid
  Variant (333)..(334): Xaa in position 333 to 334 is any amino acid
  Variant (336)..(336): Xaa in position 336 is any amino acid
  Variant (339)..(340): Xaa in position 339 to 340 is any amino acid
  Variant (342)..(343): Xaa in position 342 to 343 is any amino acid
  Variant (347)..(348): Xaa in position 347 to 348 is any amino acid
  Variant (350)..(351): Xaa in position 350 to 351 is any amino acid
  Variant (354)..(363): Xaa in position 354 to 363 is any amino acid
  Variant (364)..(366): Xaa in position 364 to 366 is any or no amino acid
  Variant (368)..(382): Xaa in position 368 to 382 is any amino acid
  Variant (384)..(385): Xaa in position 384 to 385 is any amino acid
  Variant (387)..(390): Xaa in position 387 to 390 is any amino acid
  Variant (392)..(392): Xaa in position 392 is any amino acid
  Variant (395)..(395): Xaa in position 395 is any amino acid
  Variant (397)..(397): Xaa in position 397 is any amino acid
  Variant (399)..(399): Xaa in position 399 is any amino acid
  Variant (401)..(406): Xaa in position 401 to 406 is any amino acid
  Variant (408)..(419): Xaa in position 408 to 419 is any amino acid
  Variant (421)..(438): Xaa in position 421 to 438 is any amino acid
  Variant (439)..(439): Xaa in position 439 is any or no amino acid
  Variant (441)..(445): Xaa in position 441 to 445 is any amino acid
  Variant (447)..(501): Xaa in position 447 to 501 is any amino acid
  Variant (502)..(573): Xaa in position 502 to 573 is any or no amino acid
  Variant (575)..(619): Xaa in position 575 to 619 is any amino acid
  Variant (620)..(633): Xaa in position 620 to 633 is any or no amino acid
  Variant (635)..(657): Xaa in position 635 to 657 is any amino acid
  Variant (658)..(659): Xaa in position 658 to 659 is any or no amino acid
  Variant (661)..(661): Xaa in position 661 is any amino acid
  Variant (662)..(664): Xaa in position 662 to 664 is any or no amino acid
  Variant (666)..(671): Xaa in position 666 to 671 is any amino acid
  Variant (673)..(707): Xaa in position 673 to 707 is any amino acid
  Variant (708)..(720): Xaa in position 708 to 720 is any or no amino acid
  Variant (722)..(765): Xaa in position 722 to 765 is any amino acid
  Variant (766)..(795): Xaa in position 766 to 795 is any or no amino acid
  Variant (797)..(798): Xaa in position 797 to 798 is any amino acid
  Variant (800)..(801): Xaa in position 800 to 801 is any amino acid
  Variant (803)..(818): Xaa in position 803 to 818 is any amino acid
  Variant (820)..(851): Xaa in position 820 to 851 is any amino acid
  Variant (852)..(893): Xaa in position 852 to 893 is any or no amino acid
  Variant (895)..(895): Xaa in position 895 is any amino acid
  Variant (897)..(899): Xaa in position 897 to 899 is any amino acid
  Variant (901)..(906): Xaa in position 901 to 906 is any amino acid
  Variant (907)..(922): Xaa in position 907 to 922 is any or no amino acid
  Variant (926)..(927): Xaa in position 926 to 927 is any amino acid
  Variant (929)..(930): Xaa in position 929 to 930 is any amino acid
MXXXXXRHTYXGXXXXXXXXXXXXXXXXXXXXXXXXXXXXXXXXXXXRXXXTFGPYXXGXTLGEGEFGKVKLXWXKXXXXXXXXXXXXXXXXXXXXXXXKXVAIKLIXRDXIXXXXXKEXKIYREINALKHLXHPNIXXLEEVLQNSXYIGIVLXXXXGGEFYKXIQXKRRLKEXXACRLFXQLISXVXYXHXKGLXHRDLKLENLLLDXXENLXITDFGFVNEFXXXNXXMKTSCGSPCYAAPELVXXXXXYXARKADXWSCGXILXAXLAGYLPWDDDXXNPXGXDIXXLYXYIXXTXLKFPXYIXPXPRDXLRXXLVXXPXXRIXXXXIXXHXWLXXHXXFLSXXPXXWDXXXXXXXXXXXXXPXXXXXXXXXXXXXXXSXXSXXXXRXSLXIXSXLXXXXXXPXXXXXXXXXXXXSXXXXXXXXXXXXXXXXXXXNXXXXXAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXDXXXXXXXXXXXXXXXXXXXXXXXXXPXXXXDXXXXXXDXXXXXXXXXXXXXXXXXXXXXXXXXXXXXXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXKXXSXXSXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXRXSXXXSXXXXXXXXXXXXXXXXXXXXXXSTAXXVXXFFKRRSM

SEQ ID NO: 14104 - protein, 58 aa, Artificial sequence
  protein pattern
  Variant (7)..(7): Xaa in position 7 is any amino acid
  Variant (8)..(8): Xaa in position 8 is Glu, Arg or Ser
  Variant (9)..(9): Xaa in position 9 is Asp, Gln or Arg
  Variant (11)..(11): Xaa in position 11 is Asp, Glu or Gly
  Variant (12)..(12): Xaa in position 12 is Leu or Met
  Variant (29)..(29): Xaa in position 29 is Ile or Val
  Variant (30)..(30): Xaa in position 30 is Ser or Thr
  Variant (31)..(31): Xaa in position 31 is Ala, Asn or Thr
  Variant (32)..(32): Xaa in position 32 is Glu, Lys or Arg
  Variant (33)..(33): Xaa in position 33 is Ala or Pro
  Variant (35)..(35): Xaa in position 35 is Asp or Glu
  Variant (41)..(41): Xaa in position 41 is any amino acid
  Variant (46)..(46): Xaa in position 46 is Ile or Val
  Variant (49)..(49): Xaa in position 49 is Phe or Tyr
  Variant (51)..(51): Xaa in position 51 is Ile or Met
GFVNEFXXXNXXMKTSCGSPCYAAPELVXXXXXYXARKADXWSCGXILXAXLAGYLPW

SEQ ID NO: 14105 - protein, 60 aa, Artificial sequence
  protein pattern
  Variant (8)..(8): Xaa in position 8 is Lys or Arg
  Variant (15)..(15): Xaa in position 15 is Glu or His
  Variant (16)..(16): Xaa in position 16 is Phe or Tyr
  Variant (17)..(17): Xaa in position 17 is Ala or Val
  Variant (18)..(18): Xaa in position 18 is Ala, Cys or Ser
  Variant (25)..(25): Xaa in position 25 is Phe or Tyr
  Variant (28)..(28): Xaa in position 28 is Lys or Arg
  Variant (35)..(36): Xaa in position 35 to 36 is any amino acid
  Variant (42)..(42): Xaa in position 42 is Ala or Ser
  Variant (47)..(47): Xaa in position 47 is Ala or Gly
  Variant (49)..(49): Xaa in position 49 is any amino acid
  Variant (51)..(51): Xaa in position 51 is Ile or Met
  Variant (53)..(53): Xaa in position 53 is any amino acid
  Variant (57)..(57): Xaa in position 57 is Ala or Val
EEVLQNSXYIGIVLXXXXGGEFYKXIQXKRRLKEXXACRLFXQLISXVXYXHXKGLXHRD

SEQ ID NO: 14106 - protein, 58 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (8)..(8): Xaa in position 8 is any amino acid
  Variant (11)..(11): Xaa in position 11 is Ala, Gly or Ser
  Variant (12)..(12): Xaa in position 12 is Lys or Arg
  Variant (15)..(15): Xaa in position 15 is any amino acid
  Variant (18)..(19): Xaa in position 18 to 19 is any amino acid
  Variant (21)..(21): Xaa in position 21 is Pro or Ser
  Variant (26)..(26): Xaa in position 26 is Asp or Glu
  Variant (29)..(29): Xaa in position 29 is any amino acid
  Variant (31)..(31): Xaa in position 31 is Ile or Val
  Variant (35)..(35): Xaa in position 35 is Ile or Leu
  Variant (38)..(38): Xaa in position 38 is Lys or Arg
  Variant (39)..(39): Xaa in position 39 is Ile or Met
  Variant (42)..(42): Xaa in position 42 is any amino acid
  Variant (43)..(43): Xaa in position 43 is Asp or Asn
  Variant (45)..(45): Xaa in position 45 is any amino acid
  Variant (46)..(46): Xaa in position 46 is Lys or Arg
  Variant (49)..(49): Xaa in position 49 is Asn or Thr
  Variant (50)..(50): Xaa in position 50 is Ile, Leu or Val
  Variant (51)..(52): Xaa in position 51 to 52 is any amino acid
  Variant (54)..(54): Xaa in position 54 is any amino acid
  Variant (55)..(55): Xaa in position 55 is Lys or Arg
  Variant (57)..(57): Xaa in position 57 is any amino acid
DXXXPXGXDIXXLYXYIXXTXLKFPXYIXPXPRDXLRXXLVXXPXXRIXXXXIXXHXW

SEQ ID NO: 14107 - protein, 30 aa, Artificial sequence
  protein pattern
  Variant (2)..(2): Xaa in position 2 is Lys or Arg
  Variant (3)..(3): Xaa in position 3 is any amino acid
  Variant (4)..(4): Xaa in position 4 is Ala or Val
  Variant (10)..(10): Xaa in position 10 is any or no amino acid
  Variant (12)..(12): Xaa in position 12 is any or no amino acid
  Variant (14)..(14): Xaa in position 14 is Ala, Pro or Ser
  Variant (27)..(27): Xaa in position 27 is Ala or Gly
  Variant (29)..(29): Xaa in position 29 is Pro, Ser or Thr
RXXXTFGPYXIXGXTLGEGEFGKVKLXWXK

SEQ ID NO: 14108 - protein, 41 aa, Artificial sequence
  protein pattern
  Variant (2)..(2): Xaa in position 2 is any amino acid
  Variant (9)..(9): Xaa in position 9 is Lys or Arg
  Variant (12)..(12): Xaa in position 12 is any amino acid
  Variant (14)..(15): Xaa in position 14 to 15 is any amino acid
  Variant (16)..(16): Xaa in position 16 is Asp or Asn
  Variant (17)..(17): Xaa in position 17 is any amino acid
  Variant (18)..(18): Xaa in position 18 is Asp, Glu, Arg or Ser
  Variant (21)..(21): Xaa in position 21 is any amino acid
  Variant (34)..(34): Xaa in position 34 is Ala, Ser or Thr
  Variant (39)..(39): Xaa in position 39 is Ile or Val
  Variant (40)..(40): Xaa in position 40 is any amino acid
KXVAIKLIXRDXIXXXXXKEXKIYREINALKHLXHPNIXXL

SEQ ID NO: 14109 - protein, 18 aa, Artificial sequence
  protein pattern
  Variant (4)..(4): Xaa in position 4 is any or no amino acid
  Variant (6)..(6): Xaa in position 6 is any or no amino acid
  Variant (8)..(8): Xaa in position 8 is Phe or Leu
  Variant (9)..(9): Xaa in position 9 is Asp, Glu, Gly or Asn
  Variant (17)..(17): Xaa in position 17 is Lys or Arg
  Variant (18)..(18): Xaa in position 18 is Ile or Val
STAXKXVXXFFKRRSMXX

SEQ ID NO: 14110 - protein, 15 aa, Artificial sequence
  protein pattern
  Variant (8)..(9): Xaa in position 8 to 9 is any amino acid
  Variant (13)..(13): Xaa in position 13 is Ile or Val
LENLLLDXXENLXIT

SEQ ID NO: 14111 - protein, 16 aa, Artificial sequence
  protein pattern
  Variant (2)..(2): Xaa in position 2 is any amino acid
  Variant (3)..(3): Xaa in position 3 is Pro or Ser
  Variant (5)..(5): Xaa in position 5 is Ala, Glu or Ser
  Variant (6)..(6): Xaa in position 6 is any amino acid
  Variant (10)..(10): Xaa in position 10 is Ile or Leu
  Variant (11)..(11): Xaa in position 11 is any amino acid
  Variant (13)..(13): Xaa in position 13 is Asp, Glu or Asn
  Variant (14)..(14): Xaa in position 14 is any amino acid
LXXHXXFLSXXPXXWD

SEQ ID NO: 14112 - protein, 22 aa, Artificial sequence
  protein pattern
  Variant (2)..(2): Xaa in position 2 is Asp or Asn
  Variant (5)..(5): Xaa in position 5 is any or no amino acid
  Variant (7)..(10): Xaa in position 7 to 10 is any or no amino acid
  Variant (12)..(12): Xaa in position 12 is Asp, Glu or Thr
  Variant (13)..(13): Xaa in position 13 is any amino acid
  Variant (14)..(14): Xaa in position 14 is Ala, Pro or Thr
  Variant (15)..(15): Xaa in position 15 is Ala or Leu
  Variant (16)..(20): Xaa in position 16 to 20 is any amino acid
  Variant (21)..(21): Xaa in position 21 is Pro, Gln or Ser
  Variant (22)..(22): Xaa in position 22 is Asn or Pro
RXSLXIXXXXIXXXXXXXXXXX

SEQ ID NO: 14113 - DNA, 1626 bp, Saccharomyces cerevisiae
  CDS (1)..(1626)
atggttttggctgatttggggaagcggattaattctgctgtgaataacgcgatttccaatacacaggatgactttactacatccgtagatgtaatgttaaagggcatcgtgactgcgttgttagaatcggatgtgaatattgccctggtttctaagttacgaaataatataaggtcacagctgctgagtgagaaccgtagtgagaagtccacaacaaacgcacaaactaagaagcttattcagaaaacggtgtttgatgaactgtgtaagttggtcacctgcgaaggtagtgaagagaaggcctttgtgcccaagaagagaaagacaaacatcatcatgtttgttgggctgcaaggttcaggtaaaactacttcctgtaccaagttagcagtttactactcgaagagaggtttcaaagtgggtttggtatgtgcggatactttccgtgctggtgcatttgaccaattgaaacaaaacgctataagagcaagaattccattttatgggtcatatacggagactgaccctgccaaagttgcagaagaaggtattaacaagtttaagaaagagaagtttgatatcatcatcgttgatacttcaggtaggcatcatcaagaagaagagttgttccaagaaatgattgaaatatccaatgtcatcaagcctaatcaaactatcatggttttagatgcttccattggtcaagctgcagagcaacaatccaaggctttcaaagaatcgtccgattttggtgccattatattaaccaagatggacggccacgctagagggggtggggcaatttcggccgttgcagccacaaacactccgattatctttattggtacaggtgagcacattcatgatttggaaaagttctcgcctaagtcattcatatctaaactgttgggtattggtgatatagagagtctctttgagcaattacaaaccgtttccaacaaggaagatgcaaaagccacaatggaaaacatccaaaagggtaagttcaccttgctagatttcaagaaacagatgcaaacaataatgaaaatgggtccattatcaaatatagcgcagatgattcctggtatgagtaatatgatgaatcaagtaggggaggaggaaacctctcaaaagatgaagaaaatggtttacgttttggattctatgactaaagaagaactagaatctgatggtagaatgttcattgaagagcctacaagaatggttcgtgtagctaaaggttcaggtacttctgtgttcgaggtagaaatgatattgatgcaacagcagatgatggcaagaatggcacaaaccgcaacccagcaacaaccaggagcccctggtgccaatgctaggatgcctggcatgccaaacatgccgggtatgccaaacatgcctggtatgccgaatatgcctggtatgccaaaagtgactccacaaatgatgcagcaggcacaacaaaagctgaagcaaaatccaggtctaatgcaaaatatgatgaacatgtttggtggcggaatgggcggaggaatgggcggaggaatgcctgatatgaacgaaatgatgaaaatgatgcaagatccacaaatgcaacaaatggcaaaacaattcggtatgggctaa

SEQ ID NO: 14114 - protein, 541 aa, Saccharomyces cerevisiae
MVLADLGKRINSAVNNAISNTQDDFTTSVDVMLKGIVTALLESDVNIALVSKLRNNIRSQLLSENRSEKSTTNAQTKKLIQKTVFDELCKLVTCEGSEEKAFVPKKRKTNIIMFVGLQGSGKTTSCTKLAVYYSKRGFKVGLVCADTFRAGAFDQLKQNAIRARIPFYGSYTETDPAKVAEEGINKFKKEKFDIIIVDTSGRHHQEEELFQEMIEISNVIKPNQTIMVLDASIGQAAEQQSKAFKESSDFGAIILTKMDGHARGGGAISAVAATNTPIIFIGTGEHIHDLEKFSPKSFISKLLGIGDIESLFEQLQTVSNKEDAKATMENIQKGKFTLLDFKKQMQTIMKMGPLSNIAQMIPGMSNMMNQVGEEETSQKMKKMVYVLDSMTKEELESDGRMFIEEPTRMVRVAKGSGTSVFEVEMILMQQQMMARMAQTATQQQPGAPGANARMPGMPNMPGMPNMPGMPNMPGMPKVTPQMMQQAQQKLKQNPGLMQNMMNMFGGGMGGGMGGGMPDMNEMMKMMQDPQMQQMAKQFGMG

SEQ ID NO: 14115 - DNA, 1796 bp, zea mays
  CDS (79)..(1569)
aatcctctctttccctactcgcggaagccaactccaccggcaggggaagcggaagggaagcacctcggccccggcaagatggtgctcgcacagctgggcgggagcatctcccgcgccctggcgcagatgagcaacgccacggtgatcgatgagaaggtgctcaacgagtgcctcaacgagatctcgcgcgcgctcctacaggccgatgtccagttcaagatggtccgcgacatgcaggctaacatcaagcgcatcgtcaacctcgaggcgcttgccgcaggcaccaacaagcgccgcatcatgcagcaggctgtcttcacggaactctgcaccatgttagatcccgggaagccttctttcactcccaaaaagggcaagccaagcgtagtcatgttcgttggtctgcaaggttctggtaaaactactacttgtacaaaatatgcttattatcatcagaagaaaggattcaaaccagcactggtttgtgctgatacatttagggctggtgcttttgatcagttaaagcaaaatgcaacgaaggccaagattcccttttatggaagctacatggaatctgatccagtgaaaattgctgttgagggtgtggagaggttcaagaaagaaaactgtgatctcatcattgtggacacaagtggaaggcacaaacaagaagcagcactctttgaagaaatgcggcaagtttcggaagcaacaaaaccagacctggtgatttttgtgatggacagtagtattggtcaggctgcatttgatcaagcacaggcatttaaacaaagtgtttctgttggtgctgtgattattacaaaaatggatggtcacgcaaaaggcggtggtgcccttagcgcggtcgcagcaacaaaaagtcctgttatattcattggaactggcgagcacattgacgagtttgaagtttttgatgtgaagccatttgttagtcgcctgttaggaatgggagattgggcaggctttatggacaagattcatgaagtcgtacctacggatcaacaacctgagcttctgcagaaactgtctgaaggaagctttactctcaggcttatgtatgagcagttccaaaacattctgaaaatgggtcctattggacaggtcttctctatgttgcctgggtttagcgccgaactaatgccaaaaggacatgagaaggaaagccaggctaagattaagcgctacatgacaatgatggattccatgactgatgcagagcttgacagcacaaatcctaagctgatgactgaatcacggatcattcggattgcacgggggtctggtcgtcctgtcagggatgtcatcgacatgctggaagagtataagcggcttgctaaaatctggggcaagatgaagggtctcaagatcccaaagaaaggggagatgagtgcactgtcccgcaacatgaatgttcagcacatgagcaaggtccttcctccgcagatgcttaaacagattggtggcatgggcggtctgcagtctctgatgaaacagatgggatcgaaggagatgagcggaatgtttggaggcatgggtggcgagcggtaattttacgtcctgtttttggtggatcgtcgctgtgaacttgtgatgctaaattgagagggtttagtgctgcggtctgatcatcgtcagaggtttccatgaagatcagcctgcgccatgttatggaacaggcttgctgtagctccccatgcctgaaatttaatttatatgattatgaacagtacatttgtcctcgaaaaaatgtataagatataatatttgacaaatgg

SEQ ID NO: 14116 - protein, 496 aa, zea mays
MVLAQLGGSISRALAQMSNATVIDEKVLNECLNEISRALLQADVQFKMVRDMQANIKRIVNLEALAAGTNKRRIMQQAVFTELCTMLDPGKPSFTPKKGKPSVVMFVGLQGSGKTTTCTKYAYYHQKKGFKPALVCADTFRAGAFDQLKQNATKAKIPFYGSYMESDPVKIAVEGVERFKKENCDLIIVDTSGRHKQEAALFEEMRQVSEATKPDLVIFVMDSSIGQAAFDQAQAFKQSVSVGAVIITKMDGHAKGGGALSAVAATKSPVIFIGTGEHIDEFEVFDVKPFVSRLLGMGDWAGFMDKIHEVVPTDQQPELLQKLSEGSFTLRLMYEQFQNILKMGPIGQVFSMLPGFSAELMPKGHEKESQAKIKRYMTMMDSMTDAELDSTNPKLMTESRIIRIARGSGRPVRDVIDMLEEYKRLAKIWGKMKGLKIPKKGEMSALSRNMNVQHMSKVLPPQMLKQIGGMGGLQSLMKQMGSKEMSGMFGGMGGER

SEQ ID NO: 14117 - DNA, 1904 bp, Glycine max
  CDS (118)..(1617)
attttaccggcggtggaagagagatagaccaataatctgaatctgaaacctccgtgttggtgttgcatatccaaaccctaatttggaaattgaattgttgaagggaagaagatcaagatggttctggcggagttaggtgggagcatttcgcgtgctctccagctgatgagcaatgcgacagtaatcgacgagaaggtgctcaacgattgcctcaacgacatcactcgcgctcttcttcaatccgatgttcaattcaagcttgtccgcgacatgcagaccaacatcaagaacattgtcaacctcgacgatctcgctgccggtcacaacaaacgcaggatcatccaacaagctgtgtttaacgaactctgcaaaattctggaccctgggaagccctctttcactcccaaaaagggcaaaacaagtgttgtcatgtttgttggtttgcaaggttctggaaaaaccacaacgtgtacaaagtatgcatattatcatcagaagaaaggctggaagccggctctagtatgtgcagatacattcagagctggtgcatttgatcaattgaagcaaaatgcaactaaagctaagatccctttctatggaagctatatggaatccgatccggtaaaaattgctgtggaaggtgtggagagattcaagaaagaaaactgtgatcttataattgttgatactagtgggaggcacaaacaagaagcttctctttttgaagaaatgcgccaagtttcggaagcaacgaaaccagatcttgttatatttgttatggatagcagtattggtcaggctgcttttgatcaagcccaagcatttaagcagagtgttgcagttggagctgtaattgttaccaaaatggatggccatgcaaaaggtggtggtgctcttagtgctgttgcagcaacaaagagtcctgtcatattcattggaactggagaacatatggacgagtttgaagtttttgatgttaagccatttgtcagtcgtctattaggaatgggcgactggtctgggtttatggacaaaattcatgaagtcgttcctatggatcaacaacctgaactgcttcagaagctgtcagaaggaaacttcaccttgaggattatgtatgagcagtttcagaacatacttaaaatgggtcctatcagccaggttttttctatgcttcccggatttagtgctgaattaatgccaaaaggccgtgagaaagaaagccaggcaaaaattaagcgttacatgacaatgatggattcaatgacaaacgaagagttggatagttcaaaccccaagctcatgaatgagtcacgcatgatgcggatagctcgaggtgcaggtcgtcagattagggaagtgatggagatgttggaagagtacaaacgtcttgcaaagatatggagcaaaatgaaagggcttaaaataccaaagaaaggtgatatgagtgccctatcccgaaatatgaatgcccaacacatgagcaaagtccttcctcctcagatgctgaagcaaattgggtggcatgggtgggttacaaaacttgatgaagcagatgggatccgccaaagacatgatgggaatgggaggaatgtttggtggtggtggtggtggtgattagttaattggcttgtgagctgaggattgttcctgaccatagccactgtcattgcattgtggtgttttacaactagactcgattgagcaggttatgcagttcaatcggtgttggagtgccatctgcaatagccgcaatgggtgcaagtgtctctttttgtaaaattaaatccttcttccctttttgggtatatttacttatttattattcagagcaatcaaagtaatcttattagaaattttcatagtctaggaacattaaaaacaaaagctatattcctcggatc

SEQ ID NO: 14118 - protein, 499 aa, Glycine max
MVLAELGGSISRALQLMSNATVIDEKVLNDCLNDITRALLQSDVQFKLVRDMQTNIKNIVNLDDLAAGHNKRRIIQQAVFNELCKILDPGKPSFTPKKGKTSVVMFVGLQGSGKTTTCTKYAYYHQKKGWKPALVCADTFRAGAFDQLKQNATKAKIPFYGSYMESDPVKIAVEGVERFKKENCDLIIVDTSGRHKQEASLFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQVFSMLPGFSAELMPKGREKESQAKIKRYMTMMDSMTNEELDSSNPKLMNESRMMRIARGAGRQIREVMEMLEEYKRLAKIWSKMKGLKIPKKGDMSALSRNMNAQHMSKVLPPQMLKQIGWHGWVTKLDEADGIRQRHDGNGRNVWWWWWW

SEQ ID NO: 14119 - DNA, 1904 bp, Glycine max; identical to SEQ ID NO: 14117
  CDS (166)..(1617)

SEQ ID NO: 14120 - protein, 483 aa, Glycine max
MSNATVIDEKVLNDCLNDITRALLQSDVQFKLVRDMQTNIKNIVNLDDLAAGHNKRRIIQQAVFNELCKILDPGKPSFTPKKGKTSVVMFVGLQGSGKTTTCTKYAYYHQKKGWKPALVCADTFRAGAFDQLKQNATKAKIPFYGSYMESDPVKIAVEGVERFKKENCDLIIVDTSGRHKQEASLFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQVFSMLPGFSAELMPKGREKESQAKIKRYMTMMDSMTNEELDSSNPKLMNESRMMRIARGAGRQIREVMEMLEEYKRLAKIWSKMKGLKIPKKGDMSALSRNMNAQHMSKVLPPQMLKQIGWHGWVTKLDEADGIRQRHDGNGRNVWWWWWW

SEQ ID NO: 14121 - DNA, 1491 bp, Oryza sativa (japonica cultivar-group)
  CDS (1)..(1491)
atggtgctcgcgcagctcggcgggagcatctcccgcgcgctggcgcagatgagcaacgccaccgtgatcgacgagaaggtgctcagcgactgcctcaacgagatctcgcgcgcgctcctgcagtccgacgtccagttcaagatggtccgcgatatgcagtccaacatcaagcgcatcgtcaacctcgagacgctcgccgccgggaccaacaagcggcgcatcatccagcaggccgtcttcacggagctctgcaacatgttggatcccgggaagccttccttcactcccaagaaggggaaaccttgcgtggtcatgttcgttggtttgcaaggttctggtaaaactactacttgtaccaaatatgcatattatcatcagcgcaagggatttaagccagcacttgtttgtgctgatacatttagggctggtgcttttgatcagttaaaacagaatgcaacaaaggccaagattcctttttacggaagctacatggagtctgatccagtgaaaattgctgttgagggtgtggagaggttcaagaaagaaaactgtgatctcatcattgtagatacgagtggaaggcacaaacaagaagcagccctttttgaagaaatgcgccaagtttcagaagcgacgaaaccagatctggtaatatttgtgatggacagtagtatcggtcaggctgcatttgatcaggcacaagcatttaagcaaagtgtttctgttggtgctgtgattgtcactaaaatggatggccatgcgaaaggaggtggcgcacttagcgcggttgcagcaacaaaaagtccagtgatatttattggaacaggagaacacatcgatgagtttgaagtttttgatgtgaaaccatttgtcagtcgtcttttaggcatgggagactggtcggggtttatggacaagattcatgaagtagtacccactgatcaacaacctgagcttttgcagaagctgtctgaaggaaccttcactctgagacttatgtatgagcagttccagaacatcttgaaaatgggtcctattggccaggttttctcaatgttgcctggatttagttctgaattgatgccaaagggacatgagaaggaaagccaagctaagattaaacggtacatgacgatgatggattccatgacagatggagagcttgacagcacaaatcctaaattgatgactgaatcgcgtattcttcggattgctcggggatctggccgacctgtcagagatgttgtcgacatgctcgaagagtacaagcggcttgctaaaatctggagcaagatgaaagggctcaagataccaaagaaaggagaaatgagtgcactgtcccgcaacatgaacgttcagcacatgagcaaagttctcccgccgcagatgctgaagcagataggcggcatgggtggcctgcaatctttgatgaaacaaatgggctcaaaagaaatgggtggcatgtttggaggcatgggtggtgataagtaa

SEQ ID NO: 14122 - protein, 496 aa, Oryza sativa (japonica cultivar-group)
MVLAQLGGSISRALAQMSNATVIDEKVLSDCLNEISRALLQSDVQFKMVRDMQSNIKRIVNLETLAAGTNKRRIIQQAVFTELCNMLDPGKPSFTPKKGKPCVVMFVGLQGSGKTTTCTKYAYYHQRKGFKPALVCADTFRAGAFDQLKQNATKAKIPFYGSYMESDPVKIAVEGVERFKKENCDLIIVDTSGRHKQEAALFEEMRQVSEATKPDLVIFVMDSSIGQAAFDQAQAFKQSVSVGAVIVTKMDGHAKGGGALSAVAATKSPVIFIGTGEHIDEFEVFDVKPFVSRLLGMGDWSGFMDKIHEVVPTDQQPELLQKLSEGTFTLRLMYEQFQNILKMGPIGQVFSMLPGFSSELMPKGHEKESQAKIKRYMTMMDSMTDGELDSTNPKLMTESRILRIARGSGRPVRDVVDMLEEYKRLAKIWSKMKGLKIPKKGEMSALSRNMNVQHMSKVLPPQMLKQIGGMGGLQSLMKQMGSKEMGGMFGGMGGDK

SEQ ID NO: 14123 - DNA, 1452 bp, Oryza sativa (japonica cultivar-group)
  CDS (1)..(1452)
atggtgctcgcgcagctgggcgggagcatctcccgcgcgctggcgcagatgagcaacgcgacggtgatcgacgacaaggcgttcgccgactgcctccacgagatcgcgcgcgcgctcctgcagtccgacgtgcagatcaggatggtctccgacatgcgcgccaacatccggagggccgtcaacctcgacgccctccccgccggcaccaacaagcgccgcatcatacagcaggccgtcttcgcggagctctgcaacatgcttgatccggggaagccgtccttcacccccaccaaggggaagcccagtgtggtcatgttcgtcggcttgcaaggttctgggaaaaccactacctgtaccaaatatgctcactatcatcagctgaagggctttaaaccttcattggtttgtgctgatacattcagagctggtgcctttgatcagttaaaacagaatgctacaaaggccaagattccttactatggaagctacatggaatcagacccagtgaaaattgctgttgagggtgtggagaggttcaggaaggagaagtctgatctcatcattgttgatactagcgggcgccacaagcaagaggctgcactcttcgaagaaatgcgtcaagttgcagaagcaacgaaacctgaccttgtgatattcgtgatggatggtagcattggtcaggcagcgtttgatcaggcgcaagcatttaaacagagtgcttctgttggtgctgtgattgttacgaaattggatggtcatgccaaaggaggcggtgcacttagcgcggttgcagctacaaagagccctgttgtatttattggaactggagaacacatgcaggattttgaggttttcgatgtgaaaccatttgttagtcgtctgttaggaatgggagacttgtctggcttagtgaacaagatcaaagatgctatgcctgctgatcaacaacctgagcttatgcagagactgatagaaggaacctttactctcagagtattctacgagctgttccagaatcttcttaacatgggtcctattggacaggttttatctatgatacctggatttaggtctgaactgatgccaaaaggacatgacaaggaaagccaagcaaagattaagcggtacatgactattatggattctatgacaaatgcagagcttgatagcacaaacccaaagctgatgagtgaatcacgaattaaacgggtcgctcgaggatctggcaggaccatgaaagatgtgaccgacatgctggaagagtacaagagaatcgccaaggtgtgtagcaagttgaagaagaagttgcccaagaatatggacaggaatgttatgaacaacaaggacacgctgaacaccattaacaatctcatccctaagcaattgttgaatcagatcggtggtgttaatccgttgcagagcgtcatgaagcaaatgggcttaaagacatga

SEQ ID NO: 14124 - protein, 483 aa, Oryza sativa (japonica cultivar-group)
MVLAQLGGSISRALAQMSNATVIDDKAFADCLHEIARALLQSDVQIRMVSDMRANIRRAVNLDALPAGTNKRRIIQQAVFAELCNMLDPGKPSFTPTKGKPSVVMFVGLQGSGKTTTCTKYAHYHQLKGFKPSLVCADTFRAGAFDQLKQNATKAKIPYYGSYMESDPVKIAVEGVERFRKEKSDLIIVDTSGRHKQEAALFEEMRQVAEATKPDLVIFVMDGSIGQAAFDQAQAFKQSASVGAVIVTKLDGHAKGGGALSAVAATKSPVVFIGTGEHMQDFEVFDVKPFVSRLLGMGDLSGLVNKIKDAMPADQQPELMQRLIEGTFTLRVFYELFQNLLNMGPIGQVLSMIPGFRSELMPKGHDKESQAKIKRYMTIMDSMTNAELDSTNPKLMSESRIKRVARGSGRTMKDVTDMLEEYKRIAKVCSKLKKKLPKNMDRNVMNNKDTLNTINNLIPKQLLNQIGGVNPLQSVMKQMGLKT

SEQ ID NO: 14125 - DNA, 1338 bp, Pyrococcus horikoshii OT3
  CDS (1)..(1338): transl_table=11
gtggtaatggttctagattcactaggtagggccctcagtaatgcactaaaaaagatagcaagagctggtagtgttgatgaagctctagttaaagaggttgttagggatattcagagggccctgcttcaagctgacgtcaacgttagattagttctcaagttgactaaggagattcagaggagggccctggaggaaaaacctcctgcgggaatatcaaagaaggagcatataataaagatagtttatgaggaacttacaaagtttctagggactgaagctaagccgatagagattaaggagaagccgactgtacttcttacggttggcgttcagggaagtggtaagacaacaaccgttgctaagctagcgaggtacttccagaaaaggggatataaagtcggagtggtgtgctcagatacctggaggcccggggcctatcaccaattgaaacagctcttagatccgtatcacattgaagtcttcggcgaccccaacgagaaagatgccgtaaaattggccaaagagggcgttgaatactttaagacaagagatgttgatttaataatagtggatacggcggggaggcataaggaagagaaagatcttatcgaggaaatgaggatgataagtgaagagattagacctcatgaagtaatcctcgtcatagatggaaccatagggcaacaagcatacaatcaggccctggcctttaaggaggcgacgccaatagggtcaattattgtgacaaagcttgacagttcagcaaaaggtggaggggcattatccgctgtagctgctactggggccccaataaagttcataggagttggagaaaagatagatgacttggagccctttgatccagctaggtttgtctctagattgcttggccttggagatattcaagggttacttgaaaagtttaaagaacttgaaaaagaggttgaattcaccgaggaagatatagacaggttcctgaggggtaagtttaccctgaaggatatgtatgctcagcttgaagcgatgagaaagatgggcccccttaagcagatacttagaatgatccctggtttgggatactcccttccagatgagctcatatccgtcggtgaggaaagacttagaaagttcaaggtaataatggactcaatgacagaggaagagcttatgaaccctgaaataataaattactccaggataaagagaatcgctagaggatctgggacatcgataaaggatgttaaagaattgctaactcaatataatcagatgaagaagttctttaagagtatgaataagagacaattgtcaagactggcaaggaggtttgggatgtga

SEQ ID NO: 14126 - protein, 445 aa, Pyrococcus horikoshii OT3
MVMVLDSLGRALSNALKKIARAGSVDEALVKEVVRDIQRALLQADVNVRLVLKLTKEIQRRALEEKPPAGISKKEHIIKIVYEELTKFLGTEAKPIEIKEKPTVLLTVGVQGSGKTTTVAKLARYFQKRGYKVGVVCSDTWRPGAYHQLKQLLDPYHIEVFGDPNEKDAVKLAKEGVEYFKTRDVDLIIVDTAGRHKEEKDLIEEMRMISEEIRPHEVILVIDGTIGQQAYNQALAFKEATPIGSIIVTKLDSSAKGGGALSAVAATGAPIKFIGVGEKIDDLEPFDPARFVSRLLGLGDIQGLLEKFKELEKEVEFTEEDIDRFLRGKFTLKDMYAQLEAMRKMGPLKQILRMIPGLGYSLPDELISVGEERLRKFKVIMDSMTEEELMNPEIINYSRIKRIARGSGTSIKDVKELLTQYNQMKKFFKSMNKRQLSRLARRFGM

SEQ ID NO: 14127 - DNA, 1494 bp, Arabidopsis thaliana
  CDS (1)..(1494)
atggtgttggcggagcttggaggtcggattatgagcgccatacagaagatgaacaatgtgacaataatcgatgaaaaggctctgaatgattgcttgaacgagatcactcgtgctctgctccagtccgatgtttctttcccccttgtgaaggagatgcagaccaatattaagaaaatcgtcaaccttgaggatctagcagccggccataacaagcgtcgtatcattgagcaggcgatcttcagtgaactctgtaagatgttggatccaggaaagtctgcatttgctcccaaaaaggccaaacctagtgtagttatgttcgtcggattacaaggtgaggtgctggaaaaaccacaacttgtaccaagtatgcttattatcatcagaagaaaagggtacaaaccagctctagtgtgtgcggatactttcagggcaggtgcttttgatcagctgaaacagaatgccaccaaatctaagatcccctattatggaagttacacaggatccgatcctgtgaaaattgctgttgagggagttgataggttcaagaaagaaaattgtgatcttattattgttgacaccagtggtcgccataaacaacaagcttctctctttgaagaaatgcgtcaaatttctgaagcaacgaaaccagatcttgttatatttgttatggatagcagtattggtcaaactgcgtttgaacaagctcgagcatttaaacaaactgttgctgtgggagctgtaattattactaagatggatggtcatgccaagggtggtgggactcttagcgctgttgcagctacaaaaagtcctgtcatattcattggaacaggagagcatatggatgagtttgaagtttttgatgctaaaccgtttgtcagccgtctcttaggaaatggtgatatgtctggattcgtgaataaactacaagaggtggtacctaaagatcaacagcctgaacttctggaaatgctctctcatggtaaatttacattgagaattatgtacgaccagttccagaacatgctgaacatgggcccacttaaggaggttttctccatgctacctggaatgcgtgctgaaatgatgccagagggacatgagaaagaaagccaggcgaagataaagcgatacatgacaatgatggactctatgactaatgaagaactggacagctcaaatccaaaggtgtttaacgagtcaaggataatgcggatagcaagagggtcagggaggattgtaagagaagtgatggagatgttggaagagtacaaaaggttaacaactatgtgggggaaggtgaaagggcttaagaacctagagaaaggaaatatgagcgcactctcaaaaaacaagaactcgcagcaattgagtaaggtcctaccggctcagatgctaaagcagattggcggcatgagtggtctgcagagtctcatgaagcagatgggttcaggtaaagacctgatgggaatgttcggtggccgagacgagtag

SEQ ID NO: 14128 - protein, 497 aa, Arabidopsis thaliana
MVLAELGGRIMSAIQKMNNVTIIDEKALNDCLNEITRALLQSDVSFPLVKEMQTNIKKIVNLEDLAAGHNKRRIIEQAIFSELCKMLDPGKSAFAPKKAKPSVVMFVGLQGEVLEKPQLVPSMLIIIRRKGYKPALVCADTFRAGAFDQLKQNATKSKIPYYGSYTGSDPVKIAVEGVDRFKKENCDLIIVDTSGRHKQQASLFEEMRQISEATKPDLVIFVMDSSIGQTAFEQARAFKQTVAVGAVIITKMDGHAKGGGTLSAVAATKSPVIFIGTGEHMDEFEVFDAKPFVSRLLGNGDMSGFVNKLQEVVPKDQQPELLEMLSHGKFTLRIMYDQFQNMLNMGPLKEVFSMLPGMRAEMMPEGHEKESQAKIKRYMTMMDSMTNEELDSSNPKVFNESRIMRIARGSGRIVREVMEMLEEYKRLTTMWGKVKGLKNLEKGNMSALSKNKNSQQLSKVLPAQMLKQIGGMSGLQSLMKQMGSGKDLMGMFGGRDE

SEQ ID NO: 14129 - DNA, 1557 bp, Lactococcus lactis subsp. lactis Il1403
  CDS (1)..(1557): transl_table=11
atggcatttgaaaacttaactgaacgcttacaaaacgtttttaaaaatctacgtggaaagaaaaaaattactgagacagacgtcacagaaattacaaaagaaatccgagttgctctccttgaagccgacgttgctctcccagttgtcaagaagtttattaaggcaatccgtgaacgagctgtcggtgttgaagtatcagaagcattaaacccagctcaacaagtaattaaaattgttgatgaagaattaacagctattttgggtggtggcgaagctgaattacttaaatctcctaaaattccaacaattatcatgatggttgggttgcaaggggcaggtaaaacaacttttgctggtaaacttgccaaaaaactcaaagaagagcaaaatgctcgccctttaatgattgcagccgacgtttatcgtccagcagcgattgaccaattaaaaaccttaggtgaacagcttgaaattcctgtctatgatgaaggaactgctgaaaaaccagttaatattgttcgtaatggtcttttaaaagctcaagaagaacgtaaagactatgttttgattgatactgcaggtcgtcttgaaattgacgacactttaatgaacgaattgcaagagattaaagcacttgctgaaccaactgaaattttgcttgttgttgatgcaatgactggtcaagttgcagcacaagttgccaagacttttgatgaaaaattggacattacaggtgtgattatcactaaacttgatggtgatacacgtggtggtgcggcattatcaatccgtgaaattacaggaaaaccaattaaatttacagggactggtgaaaaattaacagaccttgaagttttctatcctgatcgaatgagttcacgaattcttggaatgggtgatatgctcaccttaattgagaaggctcaagcaaattatgacgaagaacaatcagcaaaactcgctgaaaaaatggctgaaaaccgttttgattatgaggactttgttgaacaacttgatcaagtgacaaatatgggaccaatggaagatattatgaaaatgattccaggaatgtcacaaatgcctggtttagataaggttaaagttgatcctaaggatgttgccagaaaacgagcaatggtcttgtcaatgacaccggcagaacgtcatttagaggctgaactgtcaccagcccgtcgtcgtcggattgccgcaggttctggaaattcatttattgaagtaaataaattcattaagcaattcaatcagtccaaagaaatgatgcaaggaatcatgaatggtgatatgaatgctatgatgcaaaaaatgatgggtggagccggtggacaaatgccgaatatgcctgcaggttctggaatgcccgatatgtcatctttgggtgatttacaagggatgatgggcaatggttcagcaaatgggatgcccgatatgagttctatgtttggtggtggtttaaaaggtaaagcaactgagtttgctatgaaacaagccatgaaacgtgctcaaaagaaaatgaaaaaaggtaagaaaaaacgctaa

SEQ ID NO: 14130 - protein, 518 aa, Lactococcus lactis subsp. lactis Il1403
MAFENLTERLQNVFKNLRGKKKITETDVTEITKEIRVALLEADVALPVVKKFIKAIRERAVGVEVSEALNPAQQVIKIVDEELTAILGGGEAELLKSPKIPTIIMMVGLQGAGKTTFAGKLAKKLKEEQNARPLMIAADVYRPAAIDQLKTLGEQLEIPVYDEGTAEKPVNIVRNGLLKAQEERKDYVLIDTAGRLEIDDTLMNELQEIKALAEPTEILLVVDAMTGQVAAQVAKTFDEKLDITGVIITKLDGDTRGGAALSIREITGKPIKFTGTGEKLTDLEVFYPDRMSSRILGMGDMLTLIEKAQANYDEEQSAKLAEKMAENRFDYEDFVEQLDQVTNMGPMEDIMKMIPGMSQMPGLDKVKVDPKDVARKRAMVLSMTPAERHLEAELSPARRRRIAAGSGNSFIEVNKFIKQFNQSKEMMQGIMNGDMNAMMQKMMGGAGGQMPNMPAGSGMPDMSSLGDLQGMMGNGSANGMPDMSSMFGGGLKGKATEFAMKQAMKRAQKKMKKGKKKR

SEQ ID NO: 14131 - DNA, 1401 bp, Encephalitozoon cuniculi GB-M1
  CDS (1)..(1401)
atgatcacagagcttggaagatcaataacaaacaccctgtcgaacctcctgagctcgccggccaccgaccagcacattgagacggcaataagggagatatgcaactctctgattctttcgaatgtgaatcccagatatgtaagtgacctaagagacgagttgagggcaaagcttgacccgggcaagatggcgcctgggttcaacaaggctcggatggtccagaatgctgtctacgaaaggctggttgatctgctagacccgaggactgagagctacaagatcgaaaaggggagaacaagtgttgttgtgtttgtggggctccaggggtctggaaagacaaccagcatatgcaagtatgcgaacttctacaagaagaaaggatataaggtcgggatagtgtgtgcagacacgttcagagcgggggcatttgaccaagtcaggcagaatgctctgaagatcaaggttccattcttcggcagctctgaggcagatcccgtgaaggtggcgtctgcaggggtggagagatttagaaaggagaggtttgagcttattcttgtcgacaccagtggaagacacacccaggagaccgagctgtttaccgagatgaaggatatcattcgagagatcagcccgagcagcattgtgtttgtgatggatgcagggataggacagtctgcggaggaccaggcgatgggattcaaaagggctgtggatgttggatcgataatcctgaccaagatcgacggaaccaccaaggccgggggcgcaataagctctgtggcggcaacaaaatgccccatcgagtttgtagggaccggggaggggatggacgacctggaggcattcgatgcaaggagatttgtatcgcggatgcttgggatgggggatgtcgaggggctgatggaaaaggtagggagcctcggaattgacgagaaggaggttgtcaagaagctgaggcagggaaggtttacgcttggggatttctacgaccagttccagaagatcctaagccttgggccgatttccaagctgcttgagatgataccggggttctcggggctctcactgcccgacgaagacacctttaaaaagcttatatatgtgtttgactctctgagccgaggagaattagactccacgggacaagtgtttgaaaaagagccaagtaggatcatgagggtcgcccgaggaagcgggacgtctgtccagggcgttgtcgagatccttacgcagttcaagaaggcgcacgcggtgatgcaaaagatcagctccatccccgggatcgaaggcatgatgggaaatccatcctcgatgagtctggcccagaaggccaagctgaaggagcaggcaaggaatatactgccaaaggatcttcttgaccgcatgggctcaatgttttga

SEQ ID NO: 14132 - protein, 466 aa, Encephalitozoon cuniculi GB-M1
MITELGRSITNTLSNLLSSPATDQHIETAIREICNSLILSNVNPRYVSDLRDELRAKLDPGKMAPGFNKARMVQNAVYERLVDLLDPRTESYKIEKGRTSVVVFVGLQGSGKTTSICKYANFYKKKGYKVGIVCADTFRAGAFDQVRQNALKIKVPFFGSSEADPVKVASAGVERFRKERFELILVDTSGRHTQETELFTEMKDIIREISPSSIVFVMDAGIGQSAEDQAMGFKRAVDVGSIILTKIDGTTKAGGAISSVAATKCPIEFVGTGEGMDDLEAFDARRFVSRMLGMGDVEGLMEKVGSLGIDEKEVVKKLRQGRFTLGDFYDQFQKILSLGPISKLLEMIPGFSGLSLPDEDTFKKLIYVFDSLSRGELDSTGQVFEKEPSRIMRVARGSGTSVQGVVEILTQFKKAHAVMQKISSIPGIEGMMGNPSSMSLAQKAKLKEQARNILPKDLLDRMGSMF

SEQ ID NO: 14133 - DNA, 1623 bp, Corynebacterium efficiens YS-314
  CDS (1)..(1623): transl_table=11
gtgtttgagtcactgtccgatcggttgaacaatgccctcaagggcctgcgtggcaaaggcaagctcaccgaggctgacatcaatgcaacagcacgtgagatccgcctcgcgctgctcgaggccgacgtgtcgctcaccgtcgtgcgctccttcatcagccgcatcaaggaacgtgccgccggtgccgaggtctcccaggcactgaaccctgcgcagcaggtcatcaagatcgtcaatgaggagctcgtgcagatcctcggtggtgagacccgccgcctccagctggcgaagaccccgccgacggtgatcatgctcgccggtctgcagggtgccggtaagaccaccctcgccggtaagctgtccaagcacctggccgcccaggggcacaccccgatgctggtcgcctgtgacctccagcgcccgggcgcggtccagcagctgcagatcgtcggtgagcgcgccggggtcaccaccttcgccccggaccccggtaccagcatcgattcctatgagcatgagatgggcaccagccacggtgatcccgtcgccgtggcgcaggccggtatcgaggaggccaaacgcacccagcatgacatcgtcatcgtggataccgccggccgcctgggtatcgatgaaaccctgatgacccaggcccgcaacatccgtgacgccatcaaccccgatgaggtcctcttcgtcatcgactcgatgatcggtcaggatgcggtcgataccgcggaggctttccgcgacggtgtcgatttcaccggtgtcgtgctcaccaagctcgatggtgatgcccgtggcggtgccgccctgtccatccgtgaggtcaccggcaagccgatcatgttcgcctccaccggtgagaagctcgaggacttcgatgtcttccacccggagcgcatggccagccgtatcctcggcatgggtgacgtgctctcgctcatcgagcaggccgaatccgtcatggaccaggacaaggcggaggccgcggcgaagaagctgggctccggggagctgacactcgaggacttcctcgaccagatgctcatgatccgtcgcatgggtccgatcggcaacattctcaagatgctgcccggtggcaagcagatgtcggatatggcggacatggtcgatgagaagcacctcgaccgaattcaggccatcatccgcggtatgaccccggcggaacgcgacgatcccaagatcctcaacgcctcccgacgcaagcgcatcgccaacggttccggtgtgaccgtctccgaggtcaaccagctggtggaacgcttcttcgaggcgaagaagatgatgggcaagatggccggccagttcggtatgggcccggtaggtcgcagcgccaccaagaagcagcccaagggccgcaagggtaagaacggcaagcgcaaaccagcaaggcggggcccaacccagccgaagatgcccatgggcggcatgccgggtatgcccggcatgggtggagcggggatgcctgatctggcggaactgcagaagcagctcggtgccgccggcggtggcatgccgaagatcccgggtatgccgaagctgccgaaggggatggagaacatcgacctcgacaatctggacttcgggaagaaatag

SEQ ID NO: 14134 - protein, 540 aa, Corynebacterium efficiens YS-314
MFESLSDRLNNALKGLRGKGKLTEADINATAREIRLALLEADVSLTVVRSFISRIKERAAGAEVSQALNPAQQVIKIVNEELVQILGGETRRLQLAKTPPTVIMLAGLQGAGKTTLAGKLSKHLAAQGHTPMLVACDLQRPGAVQQLQIVGERAGVTTFAPDPGTSIDSYEHEMGTSHGDPVAVAQAGIEEAKRTQHDIVIVDTAGRLGIDETLMTQARNIRDAINPDEVLFVIDSMIGQDAVDTAEAFRDGVDFTGVVLTKLDGDARGGAALSIREVTGKPIMFASTGEKLEDFDVFHPERMASRILGMGDVLSLIEQAESVMDQDKAEAAAKKLGSGELTLEDFLDQMLMIRRMGPIGNILKMLPGGKQMSDMADMVDEKHLDRIQAIIRGMTPAERDDPKILNASRRKRIANGSGVTVSEVNQLVERFFEAKKMMGKMAGQFGMGPVGRSATKKQPKGRKGKNGKRKPARRGPTQPKMPMGGMPGMPGMGGAGMPDLAELQKQLGAAGGGMPKIPGMPKLPKGMENIDLDNLDFGKK

SEQ ID NO: 14135 - DNA, 1617 bp, Corynebacterium diphtheriae NCTC 13129
  CDS (1)..(1617): transl_table=11
gtgtttgaatccctatctgaccggctcggcaatgccctttctgggttgcgttctaagggcaaggttactgaggctgacatcaataccgttgcccgagagatccgccttgcgttgctcgaagccgatgtttcattaccagtcgttcgtggatttatctcgaggataaaagatcgtgcgttaggcgttgaagtctccaaagcgcttaatccagcagagcaagttatcaagattgttgatgaagagctaacgggaattcttggtggcgaaacacgacgattgaacctagcgaagaacccgccaacggtgatcatgttggctggtttgcagggtgctggtaagaccactctcgcaggtaaattggctaagcacctggtggagcaggggcatactccgatgctggttgcttgcgacttgcaacgccccggcgctgttcagcagctgacgatcgttggtgagcgagcaggtgttcctacctttgcaccggatccaggtacctctatcgattccagtgatcatgaaatgggtacgtcccatggtgacccagtagcagtggcacaacagggtatcgcagaagccaagcgtacccaacatgatattgtcatcgtcgatacagctggtcgcttgggcatcgacgaagccttgatgacgcaggctcgcaacattcgtgatgctattaatccggatgaagttctgtttgtcatcgacgcgatgattggtcaagatgcagttaatactgcagaagctttccgcgatggcgtggatttcactggtgttgttttgaccaagcttgatggtgatgcccgcggtggtgcagcgctatctattcgagaagtcaccggcaaaccgatcatgtttgcctctaccggtgaaaagcttgaagacttcgacattttccacccagagcgtatgtctagccgaattctcggcatgggcgatatgttgacgctgatcgaacaagcagaaaagaaactcgatcagcaacaagcactggaaactgcacaaaagctcggtactggcgaacttactctcgacgatttcttgaaccagatgctcatggtgcgtcgaatggggccactaggcaacattttgaagatgctgcctggtggaaaagctatgtcggacatggcggatatggttgatgagaagcagctcgaccgtattcaggcgatcattcgcggcatgactccagctgagcgcaacgatccaaagatcttgaacgcttctcgacgcaagcgtattgctcttggttcaggagtttcggtagccgaagttaatcagcttgtagagcgcttctttgaagcgaagaagatgatgaacaaaatggctggccagttcggcatgggtggtggatcgcgtagtgctaccaagaagaagcccaaaggtcgaaaaggtaaaaacggtaaacgtaagcctgctaagaatcgcagtggcggaatgccgaatatgggcggtatgccgggtatgccgaacatggcggaattgcaaaaacttcagcagcagatggagcagggtggcggtatgccagggatgggaggattccctggaatgcctaaacttccaaaaggcatggaaaatattgatctcaacaaccttgatttcggtcaaggcaagaagtaa

SEQ ID NO: 14136 - protein, 538 aa, Corynebacterium diphtheriae NCTC 13129
MFESLSDRLGNALSGLRSKGKVTEADINTVAREIRLALLEADVSLPVVRGFISRIKDRALGVEVSKALNPAEQVIKIVDEELTGILGGETRRLNLAKNPPTVIMLAGLQGAGKTTLAGKLAKHLVEQGHTPMLVACDLQRPGAVQQLTIVGERAGVPTFAPDPGTSIDSSDHEMGTSHGDPVAVAQQGIAEAKRTQHDIVIVDTAGRLGIDEALMTQARNIRDAINPDEVLFVIDAMIGQDAVNTAEAFRDGVDFTGVVLTKLDGDARGGAALSIREVTGKPIMFASTGEKLEDFDIFHPERMSSRILGMGDMLTLIEQAEKKLDQQQALETAQKLGTGELTLDDFLNQMLMVRRMGPLGNILKMLPGGKAMSDMADMVDEKQLDRIQAIIRGMTPAERNDPKILNASRRKRIALGSGVSVAEVNQLVERFFEAKKMMNKMAGQFGMGGGSRSATKKKPKGRKGKNGKRKPAKNRSGGMPNMGGMPGMPNMAELQKLQQQMEQGGGMPGMGGFPGMPKLPKGMENIDLNNLDFGQGKK

SEQ ID NO: 14137 - DNA, 1431 bp, Lactobacillus johnsonii NCC 533
  CDS (1)..(1431): transl_table=11
atggcttttgaaaatttaagtgaaagacttcaaaaagcattaaaaaatttaactggtaaaggtaagatctcagaagcggatattaatgacgctagtcgtgagattcgattggctttattagaagcggacgttaactttaaggttgtaaaagactttattaaaaaaataaaaaaggaagctttaggtaaagaagtccaagatagcttaaatccaggacaacaaatcatcaaaattgttgatgacgagttaactaaaatgatgggagaagaggctgtttctcttaataaatctccgcatattccaacaatcattatgatggtcggtttacagggtactggtaaaactactactgttggtaaacttgcaaattacttaatgaagaacgaaaaagctcgtccattgttaattgcaggtgatatttaccgtccagctgctattgagcagttaaagcaaattggtcaacaattagacgtaccggtttatagtgaagataaccaagatgtagcagaaattgtaaagcatggtcttgaagaagctgataaaaataaaaatgactatgtcttgattgatacggctgggcgtcttgaaattgatgagcaattgatggatgagttgaaacgtgtaactgaagttgctcatcctgataatactttattagttgttgatgcaatgacaggtcaagcagctacacaagtagcagaaggatttaataatgacttagatctgactggaattgttttgactaagcttgatggggatactcgtggtggtgccgcactttctattcgtgctgtcactggtcttccaattatctttaccggtcaaggtgaaaaattaacggatctttctactttccatcctgatcgaatggcttcacgtatcctaggtatgggtgatatgttgaccctaattgagaaggctcagcaagattacgatgctaaagaagccgaaaagatggctgaaaagatgcgggaaaatacttttgattttaatgattttattgatcaaatggagcaagttcaaaaaatgggtcctctagatcaaatcattaaaatgatccctggattgggtaataatcctgctcttaaaaatattcagattccggaaaaacaaatcgatcacattaaggctattgtttattcaatgaccccagaagagcgtgaaaatcctgatattcttaatccgtcaagaagacgtagaattgctgctggttccggtagatcgatcgctgaagttaaccgaatgattaaacaatttaagcaatcaaaagaaatgatgcaaaagatgaccaaaggtgatatgggtgaattggctaacttaccaggaatgaattcaccaatgggcaagatggcgatgagatcaatgaataagcgctttaagaaaaataagaagaaacggatgaagaatattaagcgttatcgttcaaaataa

SEQ ID NO: 14138 - protein, 476 aa, Lactobacillus johnsonii NCC 533
MAFENLSERLQKALKNLTGKGKISEADINDASREIRLALLEADVNFKVVKDFIKKIKKEALGKEVQDSLNPGQQIIKIVDDELTKMMGEEAVSLNKSPHIPTIIMMVGLQGTGKTTTVGKLANYLMKNEKARPLLIAGDIYRPAAIEQLKQIGQQLDVPVYSEDNQDVAEIVKHGLEEADKNKNDYVLIDTAGRLEIDEQLMDELKRVTEVAHPDNTLLVVDAMTGQAATQVAEGFNNDLDLTGIVLTKLDGDTRGGAALSIRAVTGLPIIFTGQGEKLTDLSTFHPDRMASRILGMGDMLTLIEKAQQDYDAKEAEKMAEKMRENTFDFNDFIDQMEQVQKMGPLDQIIKMIPGLGNNPALKNIQIPEKQIDHIKAIVYSMTPEERENPDILNPSRRRRIAAGSGRSIAEVNRMIKQFKQSKEMMQKMTKGDMGELANLPGMNSPMGKMAMRSMNKRFKKNKKKRMKNIKRYRSK

SEQ ID NO: 14139 - DNA, 1353 bp, Methanococcus maripaludis S2
  CDS (1)..(1353): transl_table=11
atgcttgataaattaggccagaatctctctgatgcactaaacaaacttaaaaacgctacttttgtcgataaaaaactcgtaaaagaagtaattaaagatattcaaaaggctttaatccagtctgatgttaacgtgaaattagtatttaacatgagtaaggaaattgagagaaaagctatcgatgaagcgcctccaaagggactttcaaaaaaagaacacattgtaaaaattgtttacgatgaactcgtaaaattgttaggagaaaccactcaaaaattagaacttgacccttcaaaaaaatcagtaatattacttattggtattcaaggaagcggtaagacaacgagtgctgcaaaacttgcaagatatatccagaaaaaaggtttgagacctggattaatcgcagcagatgtttacaggcctgcagcataccagcagttaaaacagctgtctgaaaaaataaacgttccactatttggtgacgaaacaagaacaaaaacacctgtagaaatcactaaagaaggaatggaaaaactaaaaaaagtagatgttataatcatcgatacagcaggtaggcacaaggaagaagaaggtcttttagctgaaatgaaagaaatgaaagatttaacgaatccaaatgaaataatccttgtaattgatggaactttaggtcagcaggctaaaaatcaagcaaaagcattcaaagaatcagtttcagaaattggaagcattctggttacaaaattagatggttctgcaaaaggtggtggtgcgttgagtgctgttgcagaaataaatgctccaattaaatttataggaactggtgaaggagtcgacaatttagaacagttcgatccaaaaaaatttatctcaagaattcttggattgggtgacttagattcccttttagaaaaaactgaagatataatggatgaatcaacagaggaaagtattgattctatcttaaaaggtaaatttacattaattgagctttatgcacagcttgaaacaatatccaaaatgggtccaatgaaacagattttaagcatgattcctggaatgggcggaaacatgccaaaagaagctgcacagttaacggaagctaaattaaaaagatacaaaatcatgatggactcaatgacaatggaagaaaaagaaaatcctgaacttataaaaacttcaaggcttcaaagaattgcaaaaggagcaggagtaaaacaggaagaaataaaggatcttttaaaatactattcaacgactaaaaatgcgtttggaaatttgaagcgcggaaaaatgccaaaaatgggcggacagatgggccagatcatgaggcagttaatgtataaagattaa

SEQ ID NO: 14140 - protein, 450 aa, Methanococcus maripaludis S2
MLDKLGQNLSDALNKLKNATFVDKKLVKEVIKDIQKALIQSDVNVKLVFNMSKEIERKAIDEAPPKGLSKKEHIVKIVYDELVKLLGETTQKLELDPSKKSVILLIGIQGSGKTTSAAKLARYIQKKGLRPGLIAADVYRPAAYQQLKQLSEKINVPLFGDETRTKTPVEITKEGMEKLKKVDVIIIDTAGRHKEEEGLLAEMKEMKDLTNPNEIILVIDGTLGQQAKNQAKAFKESVSEIGSILVTKLDGSAKGGGALSAVAEINAPIKFIGTGEGVDNLEQFDPKKFISRILGLGDLDSLLEKTEDIMDESTEESIDSILKGKFTLIELYAQLETISKMGPMKQILSMIPGMGGNMPKEAAQLTEAKLKRYKIMMDSMTMEEKENPELIKTSRLQRIAKGAGVKQEEIKDLLKYYSTTKNAFGNLKRGKMPKMGGQMGQIMRQLMYKD

SEQ ID NO: 14141 - DNA, 1533 bp, Magnaporthe grisea 70-15
  CDS (1)..(1533)
atggttcttcaagatcttgggcggcgcatcaatgccgccgtgtcagacctgacgcgggccccgaacctcgatgagaaggcaaagatttgcgccgcgcttctcgaagccgatgtcaacgtgcgcctcgtcggccagctgcgcaaatcgataaaatcaaccgtcaacttcaaggaactcccgcccgcagtcaacaagaagcggttgatccaaaaggccgtcttcgacgagcttgttagcctcgtcgatccccacgccgagcccttcaagccgaagaagggcaagtccaacgtcatcatgtttgtcggtctgcagggtgccggaaagacgacgacatgtacaaagctggcgcggcactaccagagcaggggtttcaaggcctgtctggtgtgtgccgacacctttcgagccggtgcgttcgaccagttgaagcagaacgcgaccaaggccaagataccatactacggctccctgaccgagacggatccggcggtcgtggcgagggagggtgtggacaagttcaagaaggagcggttcgaggtcattattgtcgatacctcgggaaggcacaggcaagagtcggcgctgttccaggagatgatggatattcagaaggcggtcaagccagacgaaacgatcatggttttggatgcgagcattggacaacaagccgaggcgcaggcaaaggcgttcaaggaggcggctgattttggagctattataatcacaaagacggacggccacgcaagtggtggtggtgcgatatcagcggttgcagcaacacacacccctatcgtatttatcggtaccggtgagcacatgctggatctagagcgtttcgcgccgcagcagttcatctcgaaattactggggatgggagatatggcagggcttgtggagcacgtgcagtctctcaaactagaccaaaaggataccataaaacacatcacggaaggaatattcactataagagatctgcgcgaccagctccagaacataatgaagatgggcccgctgtccaagatggcgggtatgatccccggcatgagcaacatgatgcaggggatggacgacgaggaaggaaccggcaagctgaagcgcatgatctacatctgcgattcgatgacagacaaggagctcgacagcgacggcaagatcttcacggagcagccgacgcggatgacgagggtagcgcgggggtcaggaactcacgtgcgcgaggtggaggatttgctgacgcagcagaggatgatggccggcatggccaagaagatgggaggcaacatgaagaacatgcaaagggcacagcaggccatgggcggcggcaacaagcagcagcagctcgcggctatgcagaagaggttgcagagcatgggtggtgctggcggtgccggcggcatgccggacatgggaagcctgatgaagatgctgggcggtgccggtggtggcatgcccggcggcatggacatggcggccatgatgaagcagatgggtggaatgatgggaggaggggcccaagggcgtggcaggaggtga

SEQ ID NO: 14142 - protein, 510 aa, Magnaporthe grisea 70-15
MVLQDLGRRINAAVSDLTRAPNLDEKAKICAALLEADVNVRLVGQLRKSIKSTVNFKELPPAVNKKRLIQKAVFDELVSLVDPHAEPFKPKKGKSNVIMFVGLQGAGKTTTCTKLARHYQSRGFKACLVCADTFRAGAFDQLKQNATKAKIPYYGSLTETDPAVVAREGVDKFKKERFEVIIVDTSGRHRQESALFQEMMDIQKAVKPDETIMVLDASIGQQAEAQAKAFKEAADFGAIIITKTDGHASGGGAISAVAATHTPIVFIGTGEHMLDLERFAPQQFISKLLGMGDMAGLVEHVQSLKLDQKDTIKHITEGIFTIRDLRDQLQNIMKMGPLSKMAGMIPGMSNMMQGMDDEEGTGKLKRMIYICDSMTDKELDSDGKIFTEQPTRMTRVARGSGTHVREVEDLLTQQRMMAGMAKKMGGNMKNMQRAQQAMGGGNKQQQLAAMQKRLQSMGGAGGAGGMPDMGSLMKMLGGAGGGMPGGMDMAAMMKQMGGMMGGGAQGRGRR

SEQ ID NO: 14143 - DNA, 1566 bp, Gibberella zeae PH-1
  CDS (1)..(1566)
atggttcttcaagatctcggccgtcgcatcaacgcggcggtcacaaatctcacacgagagcaaaacctcgatgaaaaggagatctgcgccgctctcctcgaagcagacgtcaacgtgaaactcgtcggccaattgcgaaagtccatcaaaacgacagtcaacttcaaagaactcccccccgccgtgaacaagaagcgcctgatccaaaaagccgtcttcgatgaactcgtcaaactcgtcgatccccacgccgaaccgttccgaccaaagaagggcaagagcaatgtcatcatgtttgtcggtctccagggtgccggaaagacaacgacctgtacaaagctcgcgcgacactaccagtcgagaggcttcaaggcttgtttggtctgtgccgacaccttccgagccggtgcttttgatcagctgaagcagaacgctaccaaggccaagattccctactatggttccctcaccgagactgatcccgccgaagtcgcccgcgctggtgtcgaccaattcaagaaagagagattcgaagtcatcattgtcgacacgtcaggtcgccatcgccaagagtctgctctgttccaggagatggtggacattcaagaagccatcaagcctgacgaaacgatcatggtcctcgacgcatcgatcggtcaacaagccgagtcacaagcgaaggcgttcaaggaagctgctgatttcggagccatcatcatcaccaagacagacggtcacgcacacggaggtggtgccatttctgctgttgcagccacgcacacccccattgtgtttatcggaactggtgaacatatgctggatttcgaaaagtttgctcctcaacaattcgtgcaaaagctgcttggcatgggcgacatggctggattgatggagcacgtccaaagtctcaacctcaaccagaaagacaccatcaagcatattcaggaaggtatctttacagtccgcgacttgagggaccagctttccaacattatgaagatgggccctctgtcaaagatggctggcatgattcctggtatgagcaacatgatgcagggtatggacgacgaggaaggtggtgccaaactcaagcgaatgatctacatctgcgattccatgaccgacaaggaactcgactccgacggcaagattctcatcgaccaaccgactcgaatgacacgaattgcccgcggctcgggtacatcagtacgagaagtcgaagatctcctcacccaacagcgaatgatggctggcatggccaagaagatgggtggcaacatgaagaacatgcagagagcacagcaagccatgggtggtggtaataaggcacaacaattagcagccatgcaaaagagactacagagtatgggaggtgcaggcggtgctggaggtatgcctgatatgggaagcttgatgaagatgcttggtggaggaggaggtggtggtatgcccggcatgcctggcggcatggatatgcaagccatgatgcgacagatgggtatgggcggcggtggtggtatgcctggcatgcccggtatgccaggaggtggcagagcaaaaagatga

SEQ ID NO: 14144 - protein, 521 aa, Gibberella zeae PH-1
MVLQDLGRRINAAVTNLTREQNLDEKEICAALLEADVNVKLVGQLRKSIKTTVNFKELPPAVNKKRLIQKAVFDELVKLVDPHAEPFRPKKGKSNVIMFVGLQGAGKTTTCTKLARHYQSRGFKACLVCADTFRAGAFDQLKQNATKAKIPYYGSLTETDPAEVARAGVDQFKKERFEVIIVDTSGRHRQESALFQEMVDIQEAIKPDETIMVLDASIGQQAESQAKAFKEAADFGAIIITKTDGHAHGGGAISAVAATHTPIVFIGTGEHMLDFEKFAPQQFVQKLLGMGDMAGLMEHVQSLNLNQKDTIKHIQEGIFTVRDLRDQLSNIMKMGPLSKMAGMIPGMSNMMQGMDDEEGGAKLKRMIYICDSMTDKELDSDGKILIDQPTRMTRIARGSGTSVREVEDLLTQQRMMAGMAKKMGGNMKNMQRAQQAMGGGNKAQQLAAMQKRLQSMGGAGGAGGMPDMGSLMKMLGGGGGGGMPGMPGGMDMQAMMRQMGMGGGGGMPGMPGMPGGGRAKR

SEQ ID NO: 14145 - DNA, 1599 bp, Candida glabrata CBS 138
  CDS (1)..(1599)
atggtgttagctgacctgggtaagcgtattaacaacgctgtgaacagtgcgttgtctaacacggaggatgactatgtgaacagcattgacggaatgcttaagggcatttcgactgctttattagaagcggatgtgaacattatgctggtgtcaaaggtgaggaataatattaggtcggttttgcttgacaataagaccactaacaggtcgatgaacaatgtgcagacgaagaagctggtgcagaagacggtgtttgatgagttgtgtggacttgttgattgtactgatcataaggttttccagcccaagaagaaagcaacgaatattatcatgtttgtgggtttgcaaggttcgggtaagactacttcgtgtactaagttggcggtatattactctaagcgtggattcaaagtgggtctagtgtgtgcggacacgtttcgtgcgggtgctttcgaccaattgaagcagaacgcagtcaaggctcgtatacctttctatggttcatacactgagacagatcctgttaaagttgctggtgatggtattgccaagtttaagaaggaaaagttcgatgtcattatcgttgatacatctggtagacatcatcaagaagaagagctgttccacgaaatggtgcaaatatccaatgttattaaaccaaaccaaacaatcatggtgctagatgcatccatcggtcaagctgcagaacagcagtccaaggctttcaaggagtcttccgactttggtgcaatcatcttaacaaaaatggatggtcacgcaaagggtggtggtgctatctcagctgtcgcagccacaaatacaccaattgcatttataggtactggtgaacatattcatgatttagaaaaattctctccaaagtcgtttatatccaagctactaggtattggtgatattgaaggtttattcgaacaattaaagactgtttctaataaggaagatacaaaagctacaatggaaaatatacaacagggtaagtttacattactggatttcaagaagcaaatgcaaactattatgaagatgggtccactttctaatatagcacaaatgatcccaggtatgggtaatatgatgagtcaggttggtgaagaggaaacatcgcagaagatgaagaaaatggtttacgttttagactcaatgacaaaagaggaactggagtctgacggtagaatatttatcgatcaaccaagtaggttagtacgagtagcaagaggttcaggtacatcggtctttgatgttgaaatgatattgatgcaacaacaaatgatggctaggatggctcagaatgcgaagatgggtaagcaaggtggaggtatgccgggtatgcctaatatgacgggtatgccaaacatgcctggtatgccaaaaatgacgcctcaactaatgcagcaagcacaacaaaagttaagacaaaatccaggcttaatgaaaaatatgatgaatatgtttggcggtgctggtggtatgggcggtatgggtggcccaggtggtatgccagatatgaatgagatgatgaaaatgatgcaagatccccaaatgcaagacatggcaagacagtttggtatgggaatgtag

SEQ ID NO: 14146 - protein, 532 aa, Candida glabrata CBS 138
MVLADLGKRINNAVNSALSNTEDDYVNSIDGMLKGISTALLEADVNIMLVSKVRNNIRSVLLDNKTTNRSMNNVQTKKLVQKTVFDELCGLVDCTDHKVFQPKKKATNIIMFVGLQGSGKTTSCTKLAVYYSKRGFKVGLVCADTFRAGAFDQLKQNAVKARIPFYGSYTETDPVKVAGDGIAKFKKEKFDVIIVDTSGRHHQEEELFHEMVQISNVIKPNQTIMVLDASIGQAAEQQSKAFKESSDFGAIILTKMDGHAKGGGAISAVAATNTPIAFIGTGEHIHDLEKFSPKSFISKLLGIGDIEGLFEQLKTVSNKEDTKATMENIQQGKFTLLDFKKQMQTIMKMGPLSNIAQMIPGMGNMMSQVGEEETSQKMKKMVYVLDSMTKEELESDGRIFIDQPSRLVRVARGSGTSVFDVEMILMQQQMMARMAQNAKMGKQGGGMPGMPNMTGMPNMPGMPKMTPQLMQQAQQKLRQNPGLMKNMMNMFGGAGGMGGMGGPGGMPDMNEMMKMMQDPQMQDMARQFGMGM

SEQ ID NO: 14147 - DNA, 1593 bp, Kluyveromyces lactis NRRL Y-1140
  CDS (1)..(1593)
atggtgttagctgatttaggaaaacgtatcaataatgcagtgacgaatgcgatttctaatgagcaaaccgattatgagactactgtccaatcgatgctcaaggaaattgctactgcattgttagaaaatgatgtaaacattaggttggtttctagacttcgtgaaaacatcaagaacactttgttatccaatgctaacgttaatgccaaatttacaaacgctcaaacgaagaaactaatccaaaagactgtatttgacgaactttgtaacttggtggactgtgaagtgacctctccatttcaacctaagaagagacagagcaacgttatcatgtttgttggtttacaaggttctggtaagaccacttcttgtacaaagctagcggtgtattactcaaaacgtggttacaaagttggtttagtttgtgctgatactttccgtgccggtgcatttgatcagttgaaacaaaatgccatcaaggccaagattccattctacggctcttatacagaacctaatccagtcaaagttgcaaaagatggtgtggacaagttcaagaaggaaaagtttgaaattataatcgtcgatacctctggtagacatcaacaggaagattctctattccaagaaatggttgaaatatcgcaagctgtcaaaccaaaacagacaattatggttcttgatgcatccattggtcaagccgcagaacatcaatctaaggctttcaaagaaagtgcagatttcggttccattattttaactaagatggatggtcatgcaagaggtggtggtgcaatctcagctgtagcatccacaaatactccaattatctttattggtactggtgaacacatccatgactttgaaaagttctctcccaagtcgtttgtttctaagcttctcggaattggtgacatcgaatctttgatggaacgtttccaaacagtatctgaccaagatgatgcaaagaatactttagagaatatccaacagggtaaattcactctacttgatttcaagaaccagatgcaaacaataatgaagatgggtcccctatcaaacatcgcgaatatgattcctggtatggggaatatgcttaaccaattctcagaagaggaaacttcaaagaaaatgaagacaatggtgtatatttttgattcaatgaccaagaaggaacttgaatcggacggtagaatcttcatcgatgaacctagtaggttggtaagagtggcaaagggttccggaacaacggtatttgatattgaaatgcttttaatgcaacaacagatgatggcaagaatggcgcaaacaactaaacaaatgggaggactcccaacaaaaggcggaatgccaccaaaggcaggtatgccttctatccctggtatgccatcaatccctggtatgccaaatatctctccacaaatgatgcaacaggctcaacagcgtatgagacagaatcctggtatgatgaacaagatgatgagtatgatgaaaggatctggaggtggtatgccaaacatgcaagatatcatgggaatgatgcaagatccaagtatgcaagaaatggccaagcaattttctgggggaatgtag

SEQ ID NO: 14148 - protein, 530 aa, Kluyveromyces lactis NRRL Y-1140
MVLADLGKRINNAVTNAISNEQTDYETTVQSMLKEIATALLENDVNIRLVSRLRENIKNTLLSNANVNAKFTNAQTKKLIQKTVFDELCNLVDCEVTSPFQPKKRQSNVIMFVGLQGSGKTTSCTKLAVYYSKRGYKVGLVCADTFRAGAFDQLKQNAIKAKIPFYGSYTEPNPVKVAKDGVDKFKKEKFEIIIVDTSGRHQQEDSLFQEMVEISQAVKPKQTIMVLDASIGQAAEHQSKAFKESADFGSIILTKMDGHARGGGAISAVASTNTPIIFIGTGEHIHDFEKFSPKSFVSKLLGIGDIESLMERFQTVSDQDDAKNTLENIQQGKFTLLDFKNQMQTIMKMGPLSNIANMIPGMGNMLNQFSEEETSKKMKTMVYIFDSMTKKELESDGRIFIDEPSRLVRVAKGSGTTVFDIEMLLMQQQMMARMAQTTKQMGGLPTKGGMPPKAGMPSIPGMPSIPGMPNISPQMMQQAQQRMRQNPGMMNKMMSMMKGSGGGMPNMQDIMGMMQDPSMQEMAKQFSGGM

SEQ ID NO: 14149 - DNA, 1707 bp, Debaryomyces hansenii CBS767
  CDS (1)..(1707)
atggttttagcagatttaggatcacgtcttagaggggcattatctaatgttgaatctggatcagagactgaaattcagtcgatgatcaaagacatttgtaacgcattattagaatcagacgttaacatcaaattggtggccaaattaagagataatattaaagccaaagtcaagacgcagattaatgatgaagaaagttctaccaataaaaggaagaagttacagaagatagtgtttgatgaattatgttcgttagtggattcccatgaagaaccaccaaaaccaaaaaaattatcccaacaacagcaaaagtccaaaaccctaagaggcaagaaggctactaaggttactggtgagtcgcatgttattatgtttgttggtttacaaggggctggtaaaaccacatcgtgtacaaaattagccgtatactacaagaagagaggttataaggtagggttagtatgtgccgataccttcagagctggagcatttgatcaattgaagcaaaatgctattaaatcttctattccatactatgggtcatacatagagactgatcccgtaaaagttgcatatgagggtgtcgtcaaattcaaacaagaaaagttcgatataattatcgttgatacttctggtagacataagcaagagcagtcattattcaatgaaatgatccaaatttcagaaatgattgttcctacccaaacaattatggttatggatggttctatcggtcaagctgctgaatctcaagctaaagccttcaaggaaagttcgcagtttggttccattattttgaccaagatggatggacatgctagaggtggtggtgctatctctgcagtggcaacaacaaaaaccccaattgttttcataggtacaggtgaacatgctaccgacttagagatttttaaaccaacatcttttatttccaaattattaggtattggtgacattcagtcattaatcgaacatgttcagtccttaaacttgcaagatgacgagtctcataaaaagaccattgaaaattttaaagaaggtaagtttactttaagagacttccaaacccagatgaataacttcatgaaaatgggacccttaacgaacattgcttccatgattccaggtatgtcgaacataatgtcccaagtaggcgaagaagaaactagttccaagatcaaaaatatgatttacataatggactcgatgactaccaaagaattagacagtgacgggcgtatcttcactcaacaaccagaaagaattatcagagtagctagaggagcaggttgttcggcagttgaggttgaaatggtcttacaacagcaaagaatgatgagtgctatggccgttaacgctaaaaatatgggtggacctcaaagtgctccaggtgctcccggtgctcccggtgctggtggaaacaatatggccagaatgatgcaacaggctcagcaaaatccaggtttcatgcaacaagccatgagtatgtttggtggcgctggtggtgctggtggtgctggtggcgctggaggtatgccggatatgtcatccatgatgaataatcctaacatgatacaacaggctcaacaaatgatgagacaaaaccctggaatgatgcaacaagctcaacaaatgatgcaaaatcctggaatgatgcaaaaaatgatgagccaatttggtggaatgggtggtggcatgggtaattga

SEQ ID NO: 14150 - protein, 568 aa, Debaryomyces hansenii CBS767
MVLADLGSRLRGALSNVESGSETEIQSMIKDICNALLESDVNIKLVAKLRDNIKAKVKTQINDEESSTNKRKKLQKIVFDELCSLVDSHEEPPKPKKLSQQQQKSKTLRGKKATKVTGESHVIMFVGLQGAGKTTSCTKLAVYYKKRGYKVGLVCADTFRAGAFDQLKQNAIKSSIPYYGSYIETDPVKVAYEGVVKFKQEKFDIIIVDTSGRHKQEQSLFNEMIQISEMIVPTQTIMVMDGSIGQAAESQAKAFKESSQFGSIILTKMDGHARGGGAISAVATTKTPIVFIGTGEHATDLEIFKPTSFISKLLGIGDIQSLIEHVQSLNLQDDESHKKTIENFKEGKFTLRDFQTQMNNFMKMGPLTNIASMIPGMSNIMSQVGEEETSSKIKNMIYIMDSMTTKELDSDGRIFTQQPERIIRVARGAGCSAVEVEMVLQQQRMMSAMAVNAKNMGGPQSAPGAPGAPGAGGNNMARMMQQAQQNPGFMQQAMSMFGGAGGAGGAGGAGGMPDMSSMMNNPNMIQQAQQMMRQNPGMMQQAQQMMQNPGMMQKMMSQFGGMGGGMGN

SEQ ID NO: 14151 - DNA, 1629 bp, Aspergillus nidulans FGSC A4
  CDS (1)..(1629)
atggttcttcaggatctagggcggcgaatcaacgccgccgtcaatgacttgactcggtcacctaatctggacgaaaagatgctgattttaggagtaaaggccttcgaagagatgctaaaggagatctgcgccgcccttctctctgccgacgtcaacgttcgtcttgttcagtcactccgcaagtctattaaagccagcgtcaacttcgcctccctccctgcagccgtgaacaagaaacgagtgattcaaaaggccgtcttcgatgagctcgtagccttggtcaacccacatgcagagccatttcgccctaagaaaggccgatcaaatgtcatcatgttcgtcggtctgcagggtgcaggtaaaacgacaacctgtaccaagcttgcccgacactatcaaatgcgcgggttcaagacggccctcgtttgtgcagacacttttcgagctggtgctttcgatcaactgaagcagaacgcgacaaaagctaagattccgtactacggtagcttaacacaaaccgacccggctgtcgtagcagcagagggtgtagccaaattcaagaaggagcgatttgagattattattgttgatactagtggtcgtcacaagcaggaagaacagctgtttacggaaatgacccaaatccagacggcggtgacgcctgaccagactattcttgtgcttgatggaacaattggacaagccgcggaggtgcaatcctcggcctttaaagccactgcagattttggagctatcataatcacaaagaccgatggtcatgcagcaggtggaggtgctatctctgcagtcgcagccactcatacccctattatctttcttggaactggtgagcatatgatggatttggagcgtttcgaacccaaagcatttatccagaagcttcttggtatgggtgacatggcgggcttagtcgagcacgttcaggccgtaacgaaggactcagccgctgccaaggaaacctacaagcatatcgctgaaggtatttataccctccgcgacttccgcgaaaacattacatcaatcatgaagatgggcccgctgtcaaagctttccggtatgatccctggcttgtcaaatcttaccgccggccttgacgatgaggacggctccatgaaactgcgccgcatgatctatatatttgacagcatgtcagccgtcgaattggacagcgacggcaagatctttgacacacagccgagccgaatggttcgtattgcccatggtagcggcacttcagtgcgcgaagttgaggatctcctgtcacaacaccgcatgatggccgggatggcgaagcgtgtcggtggccagaagaagcaaatgcaacgagcacagaatatgctcaagggtggcaacaaggatcaacagcttgctgctatgcagaagcggatggcctcgatgggtggagctggtggcatgggcggcatgcccggaatgggcgatatggcgaagatgatgcagatgctgcagggccaaggcggcggcggcggcggcggcggtggtggtggtgggctgccaggtcttggtgggatggacttgcagtcgatgatgagccagatgagcgggttgatgggcggtatgggaggtggtggaaggggacggggacggtag

SEQ ID NO: 14152 - protein, 542 aa, Aspergillus nidulans FGSC A4
MVLQDLGRRINAAVNDLTRSPNLDEKMLILGVKAFEEMLKEICAALLSADVNVRLVQSLRKSIKASVNFASLPAAVNKKRVIQKAVFDELVALVNPHAEPFRPKKGRSNVIMFVGLQGAGKTTTCTKLARHYQMRGFKTALVCADTFRAGAFDQLKQNATKAKIPYYGSLTQTDPAVVAAEGVAKFKKERFEIIIVDTSGRHKQEEQLFTEMTQIQTAVTPDQTILVLDGTIGQAAEVQSSAFKATADFGAIIITKTDGHAAGGGAISAVAATHTPIIFLGTGEHMMDLERFEPKAFIQKLLGMGDMAGLVEHVQAVTKDSAAAKETYKHIAEGIYTLRDFRENITSIMKMGPLSKLSGMIPGLSNLTAGLDDEDGSMKLRRMIYIFDSMSAVELDSDGKIFDTQPSRMVRIAHGSGTSVREVEDLLSQHRMMAGMAKRVGGQKKQMQRAQNMLKGGNKDQQLAAMQKRMASMGGAGGMGGMPGMGDMAKMMQMLQGQGGGGGGGGGGGGLPGLGGMDLQSMMSQMSGLMGGMGGGGRGRGR

SEQ ID NO: 14153 - DNA, 1671 bp, Candida albicans SC5314
  CDS (1)..(1671): transl_table=12
atggttttagcagatttaggatcaagattgaggggtgctttgtcatctgtggaatctggttctgatgacgagatccagcaaatgataaaagatatctgttcagcacttttagaatcagacgtcaatgttaaattagttgccaagttgagaggcaatatcaaaaataaaatcgacgaatccaatgtatctaaagaaacttcagctatgaataaacgtaaaaaattacaaaagatcattttcgacgaattgtgtgcgttagttgactccaatgtcgaacctccaaaaccaaagaaactttctacatcaaccaaaactatcaatgggaaaaaagtgagattgtcaaaagaatcaagtcacgttattatgtttgttggtttgcagggtgcgggtaaaaccacgtcatgtaccaaattggctgtctattataagaagaggggattcaaagttggtttagtgtgtgccgatactttcagagctggtgcttttgatcagttgaagcagaatgccataaaggcaaatataccttactatggttcgtatttggaaccagatccagttaagattgcatttgaaggggttcaaaaattcaaacaagagaaattcgatattataattgtcgatacttcaggaagacatagacaagaagaacaattgtttacagaaatggttcaaattggagaagctgtccaaccaacccaaaccataatggtgatggatggatctataggtcaggctgcagaatcacaagctcgtgcatttaaagaaagttctaattttgggtcaatcatattaaccaaaatggatggtcatgccaaaggaggtggtgctatttctgctgttgcagctacaaagacaccaattgtcttcataggtactggtgagcatgtgggtgatttagagattttcaaaccaaccacatttatttcaaaacttttaggtattggtgatattcaaggtttaattgaacatgttcagtcattgaatttgcaccaagacgaaggacataaacaaacaattgaacatataaaggaaggtaaattcacattgagagatttccaaaatcaaatgaacaatttcttgaaaatgggaccattaacaaatatagcatcgatgattcctggtctttccaatataatgtcacaagtgggagacgaagaaacatcgaaaaagatcaaaaatatgatttatatcatggattcaatgaccatcaaagaactagaaagtgatggtagaatattcataaaggaaccaagcagaatcgtcagagtagcgagaggttctgggtgtgctgttgtcgaagtggagatgatattacaacaacatagaatgatgtcaactatggccaaatctgccatggctgcacaaggtggtcaaccaggccaaccaggaaacccaatggccaacaatccacaaatgcaaagaatgatgcaacaggctcaatcaaacccaaattttatgcaacaagccatgaatatgttaggaggcgccggtggcggtgctggtggcgctgggggattagctggaatgatgaacaaccctgctatgatgcaacaagcacaacagatgatgagactgaatcctcaaatgatgcaacaggctcaacaaatgatgaaaaatccaggaatgatgcaaaagatgatgcaacagtttggtggtatgggtggtatgtaa

SEQ ID NO: 14154 - protein, 556 aa, Candida albicans SC5314
MVLADLGSRLRGALSSVESGSDDEIQQMIKDICSALLESDVNVKLVAKLRGNIKNKIDESNVSKETSAMNKRKKLQKIIFDELCALVDSNVEPPKPKKLSTSTKTINGKKVRLSKESSHVIMFVGLQGAGKTTSCTKLAVYYKKRGFKVGLVCADTFRAGAFDQLKQNAIKANIPYYGSYLEPDPVKIAFEGVQKFKQEKFDIIIVDTSGRHRQEEQLFTEMVQIGEAVQPTQTIMVMDGSIGQAAESQARAFKESSNFGSIILTKMDGHAKGGGAISAVAATKTPIVFIGTGEHVGDLEIFKPTTFISKLLGIGDIQGLIEHVQSLNLHQDEGHKQTIEHIKEGKFTLRDFQNQMNNFLKMGPLTNIASMIPGLSNIMSQVGDEETSKKIKNMIYIMDSMTIKELESDGRIFIKEPSRIVRVARGSGCAVVEVEMILQQHRMMSTMAKSAMAAQGGQPGQPGNPMANNPQMQRMMQQAQSNPNFMQQAMNMLGGAGGGAGGAGGLAGMMNNPAMMQQAQQMMRSNPQMMQQAQQMMKNPGMMQKMMQQFGGMGGM

SEQ ID NO: 14155 - DNA, 1332 bp, Methanosarcina barkeri str. Fusaro
  CDS (1)..(1332): transl_table=11
atggtaatggaaaaacttggagactccttacagggggcgctcaagaagctaatcggcgcggggcgaattgatgagcgtacggtcaatgaagtagtaaaagatatccagcgggctctgctccaggccgacgtgaatgtaaaacttgttatgggaatgtcccagagaatcaaagagcgtgcaatgaaagaagcccctcctgcaggtatgaacccgagggagcacgtaatccgcattgtataccaggaactgatggaaatcatcggcaaaggagctgaaattcagctcaagccgcagattataatgatggttgggcttcagggaagcggaaaaactaccagtacagcaaagcttgctcgctacttccagagaaaaggactcaaagcaggagttgtcgccgcagataccttccgacctggtgcatatcaccagcttaaaactctctgtgaaaagctcaacgtagctttctatggggaagaaaataatcccgatgccgtcgaaattaccagaaacgggctcaaagccctggaaaaatacgacgtaaaaattgtggataccgcaggccggcatgctcttgaagccgatcttatagaagagatggaacagatcaacgccgttgccaaaccagaccacaagttcatggtgctggatgcaggtatcggacagcaggcaagccagcaggcacatgcatttaatgattccgtaggaattacaggcgttatcataacaaaacttgacggtactgcaaaaggaggcggagctctgtctgccgtttccgaaacaaaagcacctattgcctttatcggcgttggagaaacaccggaagattttgagaaattcgaagctgacagattcatttcaaggcttcttggcatgggagaccttaaaagcctgatggaaaaggctgaagagacccttagcgaagaagacgtaaatgtcgaggccctgatgcaggggcgcttcactctcaaggatatgtacaaacagcttgaagccatgaacaaaatgggccctctcaaacagattatgtccatgctgccactgggaatgggcggaatgggaggcgttaaactctcagatgagatgttccaggctacaagtgacaagatgaagaattacaagacaatcatggactccatgacagaagaggaaatgacggaccccaagctcataggcggttccaggatcaaaaggatttcaagaggctcaggctgcagccccgaagaagtaagggagcttctgaaataccacaaaaccatgcagacagctctaaaaggcttcaggggtggaaagttcaacattcagaaaatgatgaagaaaagactcgggatgtaa

SEQ ID NO: 14156 - protein, 443 aa, Methanosarcina barkeri str. Fusaro
MVMEKLGDSLQGALKKLIGAGRIDERTVNEVVKDIQRALLQADVNVKLVMGMSQRIKERAMKEAPPAGMNPREHVIRIVYQELMEIIGKGAEIQLKPQIIMMVGLQGSGKTTSTAKLARYFQRKGLKAGVVAADTFRPGAYHQLKTLCEKLNVAFYGEENNPDAVEITRNGLKALEKYDVKIVDTAGRHALEADLIEEMEQINAVAKPDHKFMVLDAGIGQQASQQAHAFNDSVGITGVIITKLDGTAKGGGALSAVSETKAPIAFIGVGETPEDFEKFEADRFISRLLGMGDLKSLMEKAEETLSEEDVNVEALMQGRFTLKDMYKQLEAMNKMGPLKQIMSMLPLGMGGMGGVKLSDEMFQATSDKMKNYKTIMDSMTEEEMTDPKLIGGSRIKRISRGSGCSPEEVRELLKYHKTMQTALKGFRGGKFNIQKMMKKRLGM

SEQ ID NO: 14157 - DNA, 1320 bp, Methanococcoides burtonii DSM 6242
  CDS (1)..(1320): transl_table=11
atggtaatggataaactcggcagttctcttcaggacgctttaaagaaactggtcggcgctgggcgcatcgatgaaaaaacggtcactgaggtcgtaaaggatattcaaagagcattgttgcaggcggatgtcaatgtcaagcttgtaatgcagatgtccagtcacatcaaggaacgtgccttgaaggaagaagttccgcctggaatgaacccacgtgagcatgtcatcaagatcgtttatcaggaactcatcagtatcgtaggcagaagcgctgatattcctctgaaacctcagacgataatgatgattggtctgcagggcagcggtaagaccactacgacttccaaactatcccgctatttccagagaaaaggacttaagcctgctgtcatttgtgcggacacgttccgtccaggtgcatatcaacaattgaagaccctttgtgacaaattgaacgttccattctacggcgaggtaggtaatcccgatgccgtggggatcgtggaaagaggattggcagaacttgggaagaacgatgtccttatcgtggacacggcaggtcgtcactctctggaagctgacctcatcgatgagatggaacagatccatgagattgcacaaccggattacaaattactggtccttgatggtgccattggtcagcaggcaagcgagcaagcaagggctttcaatgattctgtgggtatttccggagttgtcatctccaaactagatggtactgcaaaaggtggtggggcattgtccgctgtctccgagacgaattccgccattgctttcattggtgtgggtgaaaccccggacgacctcgagaagttcgaaccggatcggttcatttcccgtcttcttggtatgggtgatatcaaatcactgatcgaaaaggcagaagaaactctttctgaagaggatattgacatggaggccatgatgcggggccgtttcactctcaaggacatgtattcacagcttgaggcaatgaacaagatgggtcctatgaaacagatcatgcaaatgctccctcttggtggtatgggtgctaagctttcagatgatgcttacaaggtcaccgaggataaaatgaaaggttatcgtgttctcatggactcaatgactgaagaggaactcctcaatccaagacttctcggtagttcacgtatcaagaggatctccttgggttcgggtagcagtccggatgctgtgcgggaacttctaaaatattataagatgatgcaaaacgccatgaaggggcttcgtggtggtaagttcaacatacagaaaatgatgaaaaagatgggaatgtaa

SEQ ID NO: 14158 - protein, 439 aa, Methanococcoides burtonii DSM 6242
MVMDKLGSSLQDALKKLVGAGRIDEKTVTEVVKDIQRALLQADVNVKLVMQMSSHIKERALKEEVPPGMNPREHVIKIVYQELISIVGRSADIPLKPQTIMMIGLQGSGKTTTTSKLSRYFQRKGLKPAVICADTFRPGAYQQLKTLCDKLNVPFYGEVGNPDAVGIVERGLAELGKNDVLIVDTAGRHSLEADLIDEMEQIHEIAQPDYKLLVLDGAIGQQASEQARAFNDSVGISGVVISKLDGTAKGGGALSAVSETNSAIAFIGVGETPDDLEKFEPDRFISRLLGMGDIKSLIEKAEETLSEEDIDMEAMMRGRFTLKDMYSQLEAMNKMGPMKQIMQMLPLGGMGAKLSDDAYKVTEDKMKGYRVLMDSMTEEELLNPRLLGSSRIKRISLGSGSSPDAVRELLKYYKMMQNAMKGLRGGKFNIQKMMKKMGM

SEQ ID NO: 14159 - DNA, 1563 bp, Mycobacterium sp. MCS
  CDS (1)..(1563): transl_table=11
gtgttcgaatccttgtccgaccggttgaccggtgccctgcaggggctgcgcaacaaaggccggttgaccgacgccgacatcgacgcgactgcccgggagatccggctggcgctgctggaggccgacgtctccctgcccgtggtgcgtgcgttcgtcgcgcgcatcaaggaacgcgccaagggcgccgaggtctcggccgcgctgaaccccgcccagcaggtcgtcaagatcgtcaacgaggagctcatcggcatcctcggcggggagacccgcccgctggtgttcgccaagaccccgccgacggtcatcatgctcgccggcctgcagggttccggtaagacgacgctggccggaaagctcgcgaagtggctgcgcggtcagggccacaccccgctgctggtggcctgcgacctgcagcgtcccggtgcggtgaaccagcttcagatcgtcggcgagcgcgcgggtgtgtcggtgttcgcaccgcaccccggcaccgcgcccggcgcaccggaggtgaagggcaccgccgacccggtcgcggtcgccgcggcgggtctcgccgaagcgaaggccaaacacttcgacgtcgtcgtcgtcgacacggcgggccgcctgggcatcgacgaggagctgatgaatcaggcggccgcgatccgcgacgccgtcgaccccgacgaggtgctgttcgtcctcgacgcgatgatcggccaggacgcggtcaccaccgccgaggcgttccgcgagggtgtcgggttcaccggcgtcgtgctgaccaaactcgacggtgacgcccgtggcggtgccgcgctgtcggtccgcgaggtcaccggcgtgccgatcctgttcgcgtccagcggtgagaagctcgaggacttcgacgtcttccaccccgaccggatggccagccgcatcctcggcatgggcgacgtgctgtcgctcatcgaggcggccgagcagcacttcgacgccgagcaggccgaggcgaccgcggccaagatcggcagcggcgagctcaccctcgaggacttcctcgagcagatgctggccatccgcaagatgggccccatcggcaacctgctgggcatgctccccggcgcgggccagatgaaggacgccctcgcagccgtcgacgacagccaactcgaccgggtgcaggcgatcatccgcggtatgacaccggccgaacgcgccgatccgaagatcatcaacgcctcccggcggttgcggatcgccaacggttcgggcgtgagcgtgtcggaggtcaaccagctcgtcgaccggttcttcgaggcccgcaagatgatgtcgcagatggcgggtcagatgggcatgccgttcgggcgtggcaagaacacccgcaagaacgccaagggcaagggcaagaaggggaagaaggccggacggggcccgacgccgccgaagaaccgcaacccgctcggtgcgggtatgccgggcatgcccgcggggttccccgacctgtccaacatgccgaaggggctcgacgagctgccacccggactggccgatttcgacctgagcaagctgaagttccccaagaactga

SEQ ID NO: 14160 - protein, 520 aa, Mycobacterium sp. MCS
MFESLSDRLTGALQGLRNKGRLTDADIDATAREIRLALLEADVSLPVVRAFVARIKERAKGAEVSAALNPAQQVVKIVNEELIGILGGETRPLVFAKTPPTVIMLAGLQGSGKTTLAGKLAKWLRGQGHTPLLVACDLQRPGAVNQLQIVGERAGVSVFAPHPGTAPGAPEVKGTADPVAVAAAGLAEAKAKHFDVVVVDTAGRLGIDEELMNQAAAIRDAVDPDEVLFVLDAMIGQDAVTTAEAFREGVGFTGVVLTKLDGDARGGAALSVREVTGVPILFASSGEKLEDFDVFHPDRMASRILGMGDVLSLIEAAEQHFDAEQAEATAAKIGSGELTLEDFLEQMLAIRKMGPIGNLLGMLPGAGQMKDALAAVDDSQLDRVQAIIRGMTPAERADPKIINASRRLRIANGSGVSVSEVNQLVDRFFEARKMMSQMAGQMGMPFGRGKNTRKNAKGKGKKGKKAGRGPTPPKNRNPLGAGMPGMPAGFPDLSNMPKGLDELPPGLADFDLSKLKFPKN

SEQ ID NO: 14161 - DNA, 1491 bp, Medicago truncatula
  CDS (1)..(1491)
atggtgctcgcagatttaggagggagcattacgcgtgctctaaagcagatgagcaatgcaacaatcattgatgaaaaagttttgaacgaatgtctcaatgaaatcactcgcgctcttcttcaatccgatgttcaattcaagcttgttagggatatgcaaaccaatattaagaagattgttaatcttgatgatcttgctgctggtcataataaacgtagaatcatccaacaagctgtgttcaatgagctctgcaatatcttggatcctggaaagcccgctttcactcccaaaaaaggaaaagctagtgttgtcatgttcgttggtttacaaggatctgggaaaaccactacttgtacaaaatatgcattttatcatcaaaagaaaggctggaagccagctctagtatgtgcagatacattcagagctggtgcgtttgatcagttgaagcaaaatgcaaccaaagctaagatccctttctatggaagctatatggagtcagatcctgtgaaaattgctgtggaaggtgtggaaagattcaagaaagaaaactgtgatcttataattgttgatactagtgggcggcacaaacaagaagctgctctttttgaagaaatgcgtcaagtttcagaagcaacgaaaccagatcttgttatctttgtcatggatagcagtattggtcaggctgcttttgatcaggcccaagcatttaaacagagtgttgcagttggagctgtcattatcacaaaaatggatggccatgcaaagggtggtggtgcacttagtgctgttgcggctacaaagagtcctgtcatattcattggaactggagaacacatggatgaatttgaagtttttgatgttaaaccatttgtcagtcgtctattaggccagggagacttgtctgggttcatgaacaaaatccatgaagttgttccaatggatcaacagcctgaactgcttaataagctgcaagaaggaacctttaccttgaggattatgtacgagcagtttcagaatattcttaagatgggtcccatgagcgaggttttttctatgctaccaggatttagcaatgaattactaccaaaaggcaaggatcaggacagccaggcaaaaattaagcgttacatgacaatgatggactcaatgacaaatgaagagttggatagttcaaacccaaagctcatgaatgagtcacggatgatgcgtatagctcgaggttctggtcggcaagttagggaagtaatggagatgatggaagagtacaagcgtctcgcaaagatatggagcaaaatgaaaggacttaaaataccaaagaagggagacatgaatagcatgactcgaaatatgaatgccacccacatgagcaaaatcctccctccacagatgctaaagcaaattggaggtatgggtgggttacaaagcttgatgaaatcgatgggatctaacaaggacatgatgggaatgtttggtggcggtggcgagcagtag

SEQ ID NO: 14162 - protein, 496 aa, Medicago truncatula
MVLADLGGSITRALKQMSNATIIDEKVLNECLNEITRALLQSDVQFKLVRDMQTNIKKIVNLDDLAAGHNKRRIIQQAVFNELCNILDPGKPAFTPKKGKASVVMFVGLQGSGKTTTCTKYAFYHQKKGWKPALVCADTFRAGAFDQLKQNATKAKIPFYGSYMESDPVKIAVEGVERFKKENCDLIIVDTSGRHKQEAALFEEMRQVSEATKPDLVIFVMDSSIGQAAFDQAQAFKQSVAVGAVIITKMDGHAKGGGALSAVAATKSPVIFIGTGEHMDEFEVFDVKPFVSRLLGQGDLSGFMNKIHEVVPMDQQPELLNKLQEGTFTLRIMYEQFQNILKMGPMSEVFSMLPGFSNELLPKGKDQDSQAKIKRYMTMMDSMTNEELDSSNPKLMNESRMMRIARGSGRQVREVMEMMEEYKRLAKIWSKMKGLKIPKKGDMNSMTRNMNATHMSKILPPQMLKQIGGMGGLQSLMKSMGSNKDMMGMFGGGGEQ

SEQ ID NO: 14163 - DNA, 1584 bp, Aspergillus oryzae
  CDS (1)..(1584)
atggtccttcaggatctcgggcggcgtatcaacgccgccgtcaatgacctgactaggtccaacaatctagacgagaaggcttttgatgacatgttgaaagagatctgcgctgcacttttatcagccgacgtaaacgttcgtctcgtccagtcacttcggaaatctatcaagtccagcgtgaacttcgcctccttgccccccgccgtcaataagaagaggttgattcagaaagcggtcttcgatgaattagttgctctggtcaatccacatgcagatcctttccgacccaagaagggccggtctaatgtgattatgttcgttggtttacagggtgctggtaagacgacaacttgtaccaagctggctagacattatcagatgcggggcttcaaaacggcactcgtctgtgcggataccttccgtgccggtgcattcgatcagctgaaacagaatgcgacaaaggccaaaattccttactatggaagtttgacgcagaccgaccccgcagtggtggcggctgagggtgtggccaagttcaagaaggagcggtttgagatcataatcgtggatactagcggtcgtcacaagcaggaggaggaacttttcacggaaatgacgcagattcagactgctgtcaccccagaccagacgatcttggtcctcgacagcacgatcggtcaagcggccgaagcccagtcggcggccttcaaggcaacagctgattttggtgccatcattatcacgaagacggacgggcatgctgctggaggtggtgctatttctgctgtagcagctacacatactcccattatcttcctcggcacgggtgaacatatgatggaccttgaacggttcgagccaaaagcttttatccagaagctactgggcatgggcgatatggcaggattagtcgagcacgttcaggccgtgaccaaggactcagtagcagccaaggagacgtacaagcacatctcggaaggtatctatacggtgcgtgatttccgagagaacatttcctcgatcatgaaaatgggtcccctgtcaaaactttctggcatgatccctggcttgtccaatctcactgctgggctggatgatgaagatggctcgcttaaactccgccgcatgatctacatttttgacagtatgactacggcagagcttgacagcgatggcaaggtctttgtggagcagcctagccggatggtccgcatcgcctgtggtagcggcacgaccgtgcgcgaggtcgaagaccttctgtcgcagcaccgcatgatggccggtatggccaagcgcgtcggtgggcagaagaagcagatgcaacgagcccagaatatgctcaagggtggcaataaagaacagcagctcgccgcgatgcagaagcgcatggcctccatgggtggcgcaggtggcgcaggtttccctggaatgcccggtatgggcgatatggccaagatgatgcaaatgctccagggacaaggcggcggtggtggtctgccaggccttggaggtatggacctacaggggatgatgagccaaatgagcggattgatgggcggaggaggacgcggtagaggacggtga

SEQ ID NO: 14164 - protein, 527 aa, Aspergillus oryzae
MVLQDLGRRINAAVNDLTRSNNLDEKAFDDMLKEICAALLSADVNVRLVQSLRKSIKSSVNFASLPPAVNKKRLIQKAVFDELVALVNPHADPFRPKKGRSNVIMFVGLQGAGKTTTCTKLARHYQMRGFKTALVCADTFRAGAFDQLKQNATKAKIPYYGSLTQTDPAVVAAEGVAKFKKERFEIIIVDTSGRHKQEEELFTEMTQIQTAVTPDQTILVLDSTIGQAAEAQSAAFKATADFGAIIITKTDGHAAGGGAISAVAATHTPIIFLGTGEHMMDLERFEPKAFIQKLLGMGDMAGLVEHVQAVTKDSVAAKETYKHISEGIYTVRDFRENISSIMKMGPLSKLSGMIPGLSNLTAGLDDEDGSLKLRRMIYIFDSMTTAELDSDGKVFVEQPSRMVRIACGSGTTVREVEDLLSQHRMMAGMAKRVGGQKKQMQRAQNMLKGGNKEQQLAAMQKRMASMGGAGGAGFPGMPGMGDMAKMMQMLQGQGGGGGLPGLGGMDLQGMMSQMSGLMGGGGRGRGR

SEQ ID NO: 14165 - DNA, 1440 bp, Arabidopsis thaliana
  CDS (1)..(1440)
atggtgttggcggagctcggcggccggataacccgcgccatacagcagatgaacaatgtgacaataatcgatgaaaaggttttgaatgatttcttaaacgagattactcgcgctttgctccagtccgatgtttcttttggccttgtggaaaagatgcagaccaatattaagaagatcgttaacctcgacgatctagcagctggccacaacaaacgcctgatcatcgagcaggctatcttcaaggaactctgtaggatgctggatccaggaaagcctgcctttgcccccaaaaaggccaaacctagtgtagtgatgttcgtcggtttacaaggtgctggaaaaaccacaacatgtaccaagtatgcttactatcatcagaagaaagggtacaaagcagctctagtgtgtgcggatactttcagggccggtgcttttgatcagctgaaacagaatgccaccaaggctaagatccccttttatggaagctacacagaatccgatcctgtgaaaattgctgttgagggagttgataggttcaagaaagaaaagtgtgatcttattattgttgacaccagtggtcgccataaacaagcagcttctctctttgaagaaatgcgtcaagttgctgaagcaacggaaccagatcttgttatatttgttatggatagcagtattggtcaagctgcatttgaacaagctgaagcttttaaggaaactgtatctgttggagctgtaattattactaagatggacggccatgccaagggaggtggtgctcttagcgctgttgcagctacaaaaagtcctgtgatattcattggaacaggagagcatatggatgagtttgaagtgtttgacgttaaaccatttgtcagccgtctcttaggaaagggtgattggtctggactcgtggataaactacaagaggtggtacctaaagatctacagaatgaacttgtagaaaatctctctcagggtaactttacgttgagaagtatgtacgaccagttccagtgctctctgcggattccacttaatcagcttttctcgatgctgcctggaattagtgctgaaatgatgccgaaaggacatggtgaagaaagccgagtgaagatgaagcgatacatgacaatgatggattctatgacaaataaagaacttgacagcccaaacccaaagatttttaacgagtcaaggataatgaggatagcgagagggtcagggaggttagtaagagaagtgatggagatgttggaagagtacaagaggatagcaaagacaatgaaagggatcaagatcccaaagaacggagacatgagcaaggtcataccgcctcagatgctaaaacagatgggcggcatgagcggtctgcagagtctcatgaagcagatgggttcggctaaggacatgatgggaatgtttggtggcggaggcaagtag

SEQ ID NO: 14166 - protein, 479 aa, Arabidopsis thaliana
MVLAELGGRITRAIQQMNNVTIIDEKVLNDFLNEITRALLQSDVSFGLVEKMQTNIKKIVNLDDLAAGHNKRLIIEQAIFKELCRMLDPGKPAFAPKKAKPSVVMFVGLQGAGKTTTCTKYAYYHQKKGYKAALVCADTFRAGAFDQLKQNATKAKIPFYGSYTESDPVKIAVEGVDRFKKEKCDLIIVDTSGRHKQAASLFEEMRQVAEATEPDLVIFVMDSSIGQAAFEQAEAFKETVSVGAVIITKMDGHAKGGGALSAVAATKSPVIFIGTGEHMDEFEVFDVKPFVSRLLGKGDWSGLVDKLQEVVPKDLQNELVENLSQGNFTLRSMYDQFQCSLRIPLNQLFSMLPGISAEMMPKGHGEESRVKMKRYMTMMDSMTNKELDSPNPKIFNESRIMRIARGSGRLVREVMEMLEEYKRIAKTMKGIKIPKNGDMSKVIPPQMLKQMGGMSGLQSLMKQMGSAKDMMGMFGGGGK

SEQ ID NO: 14167 - DNA, 1494 bp, Hordeum vulgare
  CDS (1)..(1494)
atggtgctcgcgcagctgggcgggagcatctcccgcgcgctcgcgcagatgagcaacgccacggtgatcgacgagaaggtgctcggggagtgcctcaacgagatctcccgcgcgctgctgcagtccgacgtccagttcaagatggtccgcgacatgcagaccaacatcaggaagatcgtcaacctcgagaccctcgccgccggcaccaacaagcgacgcatcatacagcaggccgtcttcacggagctctgcaacatgctcgatccaggcaagccggccttcaccaccaagaagggcaagcccagcgtcgtcatgttcgtcgggttgcaaggttctggaaaaactactacctgtaccaaatacgcatattatcatcagcggaagggattcaaaccatcattggtttgtgccgatacatttcgagctggtgcttttgatcagttgaaacagaatgcaaccaaggctaagatacctttttacggaagctacatggaatcagatcctgtgaaaattgctgttgagggtctagaaaggttcaggaaagagaactctgatctcatcattattgatacgagtggacgccataagcaggaggctgcactctttgaggaaatgcgtcaagttgccgaagcaacgaaaccagacctggtgatatttgtgatggatggcagcattggtcaggctgcatttgatcaggcacaggcatttaaacaaagtgcttctgttggtgctgtgattattacgaaattggatggtcatgcaaaaggaggcggtgcactgagcgcggttgcagctacaaaaagcccagtgatatttattggaactggagaacatattgatgaatttgagatttttgatgtgaagccatttgtcagccggctgctaggtatgggtgacttgtctggcttaatggacaagatccaggatgttatgcctgctgatcaacaacctgagcttctggcaaagctggctgaaggaaccttcactctcagacttctgtatgagcaatttcagaatcttctgaaaatgggtccaattggccaggtattctccatgttgcctggatttagttcagagttgatgccaaaaggacacgagaaagaaggccaagcaaagattaagcggtacatgacgatcatggactccatgacagctgcagagctcgacagcacaaacccgaagctgatgacagagtctcgaatcatccggatcgctcgagggtctggcaggcaaatcagagacgtgacggacatgctggaagagtacaagcggctagccaagatgtggagcaagatgaaggggctaaagatgccgaagaacggaaagatgagcgatctgtcccagaacctgaacatccagcagatgaccaaagccctcccgccccaagtgctgaagcagatgggcggcatgggtggcctgcaggccctgatgaagcagatgggcggcaaggacatgagcaaaatgctcggtggcatgggactgggtggtgattag

SEQ ID NO: 14168 - protein, 497 aa, Hordeum vulgare
MVLAQLGGSISRALAQMSNATVIDEKVLGECLNEISRALLQSDVQFKMVRDMQTNIRKIVNLETLAAGTNKRRIIQQAVFTELCNMLDPGKPAFTTKKGKPSVVMFVGLQGSGKTTTCTKYAYYHQRKGFKPSLVCADTFRAGAFDQLKQNATKAKIPFYGSYMESDPVKIAVEGLERFRKENSDLIIIDTSGRHKQEAALFEEMRQVAEATKPDLVIFVMDGSIGQAAFDQAQAFKQSASVGAVIITKLDGHAKGGGALSAVAATKSPVIFIGTGEHIDEFEIFDVKPFVSRLLGMGDLSGLMDKIQDVMPADQQPELLAKLAEGTFTLRLLYEQFQNLLKMGPIGQVFSMLPGFSSELMPKGHEKEGQAKIKRYMTIMDSMTAAELDSTNPKLMTESRIIRIARGSGRQIRDVTDMLEEYKRLAKMWSKMKGLKMPKNGKMSDLSQNLNIQQMTKALPPQVLKQMGGMGGLQALMKQMGGKDMSKMLGGMGLGGD

SEQ ID NO: 14169 - DNA, 1491 bp, Solanum lycopersicum
  CDS (1)..(1491)
atggtgttagcacaattaggggggagcatctcgcgtgctctccagcagatgagcaatgccacaatcatcgatgaaaaggtcctcaacgagtgcctcaatgagatcacccgtgctcttctacaggccgatgttcaatttaagctagttcgtgatatgtcaacaaatatcaagaagattgtcaatcttgaagatcttgccgctggacacaacaagcgtaggattattcaacaggctgtgtataatgagctctgcaagatattggatcctgggaaacctgcatttacacttaaaaaagggaaacctagtgttgtaatgtttgttggtttgcaagggtctggaaaaactacaacgtgtacaaaatatgcttaccaccaccagaaaaggggttggaagccggctctagtctgtgcagataccttcagagctggtgctttcgatcaattgaagcagaatgctacaaaagctaaaattcctttttatggaagcagctatacagaatcagatccagtgaaaatagccgtggacggtgtagaaacatttaagaaggaaaattgtgatctaataattgtggataccagtgggcgccacaaacaagaagcagctctttttgaagaaatgcgacaagtttctgaagcacagaaaccggatctcgtgatttttgttatggatagtagtattggacaagctgcttttgatcaagctcaagcatttcgacaaagtgttgcggttggagccgtgattgttactaagatggatggccatgcaaaaggaggtggtgccctaagcagagttgctgcaactaaaagtccagtcatatttattggaactggtgaacacatggacgagtttgaagtttttgatgttaaaccatttgtcagccgtcttttaggcatgggtgacttgtctggattggtgaacaagatacaagatgtggtcccaatggatcaacagcctgagcttcttcagaagttatcagaaggacattttaccttgaggatcatgtacgagcaatttcagagcatgcttaaaatgggtccccttggagttttttcaatgcttcctggatttagtgcagagatgatgccacaaggtcgtgaaaaggaaagtcaagcaaagtttaaaaggtatatgacaatgatggactccatgactgatgaagaattggacagtaccaatccaaagattttgactgaatctcggatcatgcgtatagctaggggatctggccgcctcgtgcatgaggtgatggagatgttggaagaatacaaacgacttgccaaaatattcagcaagatgaagggtcttaagattccaaagaagggagatatgagctccctgtcgagaaacatgaatgcacaaaacatgagcaaagtcctcccccctcagatgttgaagcagatcggtggaatgggtggtttgcagaacttaatgaagcaaatgggttccgccaaggacatgatgggtatgtttggtggtggtggtggagagtaa

SEQ ID NO: 14170 - protein, 496 aa, Solanum lycopersicum
MVLAQLGGSISRALQQMSNATIIDEKVLNECLNEITRALLQADVQFKLVRDMSTNIKKIVNLEDLAAGHNKRRIIQQAVYNELCKILDPGKPAFTLKKGKPSVVMFVGLQGSGKTTTCTKYAYHHQKRGWKPALVCADTFRAGAFDQLKQNATKAKIPFYGSSYTESDPVKIAVDGVETFKKENCDLIIVDTSGRHKQEAALFEEMRQVSEAQKPDLVIFVMDSSIGQAAFDQAQAFRQSVAVGAVIVTKMDGHAKGGGALSRVAATKSPVIFIGTGEHMDEFEVFDVKPFVSRLLGMGDLSGLVNKIQDVVPMDQQPELLQKLSEGHFTLRIMYEQFQSMLKMGPLGVFSMLPGFSAEMMPQGREKESQAKFKRYMTMMDSMTDEELDSTNPKILTESRIMRIARGSGRLVHEVMEMLEEYKRLAKIFSKMKGLKIPKKGDMSSLSRNMNAQNMSKVLPPQMLKQIGGMGGLQNLMKQMGSAKDMMGMFGGGGGE

SEQ ID NO: 14171 - DNA, 1488 bp, Arabidopsis thaliana
  CDS (1)..(1488)
atggtgttggcggagcttggaggtcggattatgagcgccatacagaagatgaacaatgtgacaataatcgatgaaaaggctctgaatgattgcttgaacgagatcactcgtgctctgctccagtccgatgtttctttcccccttgtgaaggagatgcagaccaatattaagaaaatcgtcaaccttgaggatctagcagccggccataacaagcgtcgtatcattgagcaggcgatcttcagtgaactctgtaagatgttggatccaggaaagtctgcatttgctcccaaaaaggccaaacctcgtgtagttatgttcgtcggattacaaggttctggaaaaaccacaacttgtaccaagtatgcttattatcatcagaagaaagggtacaaaccagctctagtgtgtgcggatactttcagggcaggtgcttttgatcagctgaaacagaatgccaccaaatctaagatcccctattatggaagttacacaggatccgatcctgtgaaaattgctgttgagggagttgataggttcaagaaagaaaattgtgatcttattattgttgacaccagtggtcgccataaacaacaagcttctctctttgaagaaatgcgtcaaatttctgaagcaacgaaaccagatcttgttatatttgttatggatagcagtattggtcaaactgcgtttgaacaagctcgagcatttaaacaaactgttgctgtgggagctgtaattattactaagatggatggtcatgccaagggtggtgggactcttagcgctgttgcagctacaaaaagtcctgtcatattcattggaacaggagagcatatggatgagtttgaagtttttgatgctaaaccgtttgtcagccgtctcttaggaaatggtgatatgtctggattcgtgaataaactacaagaggtggtacctaaagatcaacagcctgaacttctggaaatgctctctcatggtaaatttacattgagaattatgtacgaccagttccagaacatgctgaacatgggcccacttaaggaggttttctccatgctacctggaatgcgtgctgaaatgatgccagagggacatgagaaagaaagccaggcagagataaagcgatacatgacaatgatggactctatgactaatgaagaactggacagctcaaatccaaaggtgtttaacgagtcaaggataatgcggatagcaagagggtcagggaggattgtaagagaagtgatggagatgttggaagagtacaaaaggttaacaactatgtgggggaaggtgaaagggcttaagaacctagagaaaggaaatatgagcgcactctcaaaaaacaagaactcgcagcaattgagtaaggtcctaccggctcagatgctaaagcagattggcggcatgagtggtctgcagagtctcatgaagcagatgggttcaggtaaagacctgatgggaatgttcggtggccgagacgagtag

SEQ ID NO: 14172 - protein, 495 aa, Arabidopsis thaliana
MVLAELGGRIMSAIQKMNNVTIIDEKALNDCLNEITRALLQSDVSFPLVKEMQTNIKKIVNLEDLAAGHNKRRIIEQAIFSELCKMLDPGKSAFAPKKAKPRVVMFVGLQGSGKTTTCTKYAYYHQKKGYKPALVCADTFRAGAFDQLKQNATKSKIPYYGSYTGSDPVKIAVEGVDRFKKENCDLIIVDTSGRHKQQASLFEEMRQISEATKPDLVIFVMDSSIGQTAFEQARAFKQTVAVGAVIITKMDGHAKGGGTLSAVAATKSPVIFIGTGEHMDEFEVFDAKPFVSRLLGNGDMSGFVNKLQEVVPKDQQPELLEMLSHGKFTLRIMYDQFQNMLNMGPLKEVFSMLPGMRAEMMPEGHEKESQAEIKRYMTMMDSMTNEELDSSNPKVFNESRIMRIARGSGRIVREVMEMLEEYKRLTTMWGKVKGLKNLEKGNMSALSKNKNSQQLSKVLPAQMLKQIGGMSGLQSLMKQMGSGKDLMGMFGGRDE

SEQ ID NO: 14173 - DNA, 1494 bp, Hordeum vulgare
  CDS (1)..(1494)
atggtgctcgcgcagctgggcgggagcatctcccgcgcgctcgcgcagatgagcaacgccacggtgatcgacgagaaggtgctcggggagtgcctcaacgagatctcccgcgcgctgctgcagtccgacgtccagttcaagatggtccgcgacatgcagaccaacatcaggaagatcgtcaacctcgagaccctcgccgccggcaccaacaagcgacgcatcatacagcaggccgtcttcacggagctctgcaacatgctcgatccaggcaagccggccttcacccccaagaagggcaagcccagcgtcgtcatgttcgtcgggttgcaaggttctggaaaaactactacctgtaccaaatacgcatattatcatcagcggaagggattcaaaccatcattggtttgtgccgatacatttcgagctggtgcttttgatcagttgaaacagaatgcaaccaaggctaagatacctttttacggaagctacatggaatcagatcctgtgaaaattgctgttgagggtctagaaaggttcaggaaagagaactctgatctcatcattattgatacgagtggacgccataagcaggaggctgcactctttgaggaaatgcgtcaagttgccgaagcaacgaaaccagacctggtgatatttgtgatggatggcagcattggtcaggctgcatttgatcaggcacaggcatttaaacaaagtgcttctgttggtgctgtgattattacgaaattggatggtcatgcaaaaggaggcggtgcactgagcgcggttgcagctacaaaaagcccagtgatatttattggaactggagaacatattgatgaatttgagatttttgatgtgaagccatttgtcagccggctgctaggtatgggtgacttgtctggcttaatggacaagatccaggatgttatgcctgctgatcaacaacctgagcttctggcaaagctggctgaaggaaccttcactctcagacttctgtatgagcaatttcagaatcttctgaaaatgggtccaattggccaggtattctccatgttgcctggatttagttcagagttgatgccaaaaggacacgagaaagaaggccaagcaaagattaagcggtacatgacgatcatggactccatgacagctgcagagctcgacagcacaaacccgaagctgatgacagagtctcgaatcatccggatcgctcgagggtctggcaggcaaatcagagacgtgacggacatgctggaagagtacaagcggctagccaagatgtggagcaagatgaaggggctaaagatgccgaagaacggaaagatgagcgatctgtcccagaacctgaacatccagcagatgaccaaagccctcccgccccaagtgctgaagcagatgggcggcatgggtggcctgcaggccctgatgaagcagatgggcggcaaggacatgagcaaaatgctcggtggcatgggactgggtggtgattag

SEQ ID NO: 14174 - protein, 497 aa, Hordeum vulgare
MVLAQLGGSISRALAQMSNATVIDEKVLGECLNEISRALLQSDVQFKMVRDMQTNIRKIVNLETLAAGTNKRRIIQQAVFTELCNMLDPGKPAFTPKKGKPSVVMFVGLQGSGKTTTCTKYAYYHQRKGFKPSLVCADTFRAGAFDQLKQNATKAKIPFYGSYMESDPVKIAVEGLERFRKENSDLIIIDTSGRHKQEAALFEEMRQVAEATKPDLVIFVMDGSIGQAAFDQAQAFKQSASVGAVIITKLDGHAKGGGALSAVAATKSPVIFIGTGEHIDEFEIFDVKPFVSRLLGMGDLSGLMDKIQDVMPADQQPELLAKLAEGTFTLRLLYEQFQNLLKMGPIGQVFSMLPGFSSELMPKGHEKEGQAKIKRYMTIMDSMTAAELDSTNPKLMTESRIIRIARGSGRQIRDVTDMLEEYKRLAKMWSKMKGLKMPKNGKMSDLSQNLNIQQMTKALPPQVLKQMGGMGGLQALMKQMGGKDMSKMLGGMGLGGD

SEQ ID NO: 14175 - DNA, 1500 bp, Solanum lycopersicum
  CDS (1)..(1500)
atggtgttagcagaattaggggggagcatatcgcgtgctctccagcagatgagcaatgctacaattattgatgagaaagttctgaacgaatgcctcaatgaaatcactcgtgctcttcttcaagctgatgttcagtttaagcttgttcgtgatatgaccactaatattaagaaaattgtcaatcttgacgatcttgctgctggacataacaagcgtaggatcatccaacaggcggtttttaatgagctctgcaaaatattggatcctgggaagccttcttttacaccgaaaaaaggaaaacccagtattgtcatgtttgttggtttgcaagggtctggaaagacaacaacatgtacaaagtatgcatattaccaccagaaaaaaggttggaaaccagctttagtgtgtgctgatacatttagagctggtgctttcgatcaattgaagcagaatgcaacaaaagccaagatacccttttatgggagctacacggagtcagaccctgtgaaaatagcagttgatggtgttgaaacatttaagaaggaaaattgtgatctaataattgttgatacaagtggacgccacaaacaagaagctgctctttttgaagagatgcgacaagttgctgaagcaacgaaaccagatcttgtgatttttgttatggatagcagtattggtcaagctgcctttgatcaagctcaagcatttaagcaaagtgttgcagtaggagctgtaattgttactaagatggatggtcatgcaaaaggaggtggtgccctcagtgcagttgctgcaacaaaaagtcccgtcatttttattggaactggtgaacacatggacgagtttgaagtttttgatgttaagccatttgtcagccgtcttttaggcatgggtgattggtctgggttcatggacaagatacatgaggttgtcccgatggatcaacagcctgaacttcttcagaagctatcggaaggacattttaccttgaggattatgtatgagcaatttcagaacatacttaaaatgggccccattggccaggtcttttccatgcttccaggattcagtgcagagttgatgccaaaaggacgtgaaaatgaaagccaggcaaaaattaaacgatacatgacaatgatggactcaatgactaatgaagaattggatagttccaaccctaagcttatgaccgactcccgaattatgcggatagctaggggttccggccgccaagtgcatgaggtaatggatatgatggaggaatacaaacgactggctaagatatggagtaagatgaagggacttaagattccaaagaagggagagatgagcgccttgtctcgaaacatgaatgcacaacacatgagcaaagtcttgcctccccagatgttgaaacaaataggcggtatgggtggtttgcagaacttgatgaagcaaatgggttctgccaaggacatgatgggtggtatgggtggtatgtttggtggtggagacaagtaa

SEQ ID NO: 14176 - protein, 499 aa, Solanum lycopersicum
MVLAELGGSISRALQQMSNATIIDEKVLNECLNEITRALLQADVQFKLVRDMTTNIKKIVNLDDLAAGHNKRRIIQQAVFNELCKILDPGKPSFTPKKGKPSIVMFVGLQGSGKTTTCTKYAYYHQKKGWKPALVCADTFRAGAFDQLKQNATKAKIPFYGSYTESDPVKIAVDGVETFKKENCDLIIVDTSGRHKQEAALFEEMRQVAEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGHFTLRIMYEQFQNILKMGPIGQVFSMLPGFSAELMPKGRENESQAKIKRYMTMMDSMTNEELDSSNPKLMTDSRIMRIARGSGRQVHEVMDMMEEYKRLAKIWSKMKGLKIPKKGEMSALSRNMNAQHMSKVLPPQMLKQIGGMGGLQNLMKQMGSAKDMMGGMGGMFGGGDK

SEQ ID NO: 14177 - DNA, 1488 bp, Arabidopsis thaliana
  CDS (1)..(1488)
atggtgttggcggagctaggcgggcggattacccgcgcgatacagcagatgagcaatgtgacaattatcgatgagaaggctttgaatgaatgcttgaacgagatcactcgtgctttgcttcaatccgatgtttcatttccccttgtgaaagagatgcagagtaatattaagaaaatcgtcaatcttgaagatctagcagctggtcacaacaagcgccggatcattgaacaggctatctttagtgaactctgtaagatgttggatccagggaagcctgcgtttgctcctaaaaaagctaaagctagtgtagttatgtttgttggattacaaggtgctggaaagacgacaacttgtactaagtatgcttattatcatcagaagaaaggatacaaaccagctttggtttgtgcggatactttcagggctggtgcgttcgatcagctgaaacagaatgctaccaaggctaagatccccttttatggaagctacacggaatccgatcctgtgaaaattgctgttgagggagtagatacgtttaagaaagaaaactgtgatctcattattgttgataccagtggtcgccataaacaagaagcttctctctttgaagaaatgcgtcaagttgctgaagcaacgaaaccagatcttgttatatttgttatggatagcagtattggtcaagctgcatttgatcaagctcaagcctttaagcagagtgttgctgttggagctgtaattattactaagatggacggccatgccaagggtggtggggctcttagcgctgttgcagctacgaaaagtcctgtgatatttatcggaacaggagagcatatggatgagtttgaagtgtttgacgtcaaaccatttgtcagccgtctcttaggaatgggtgattggtctggattcgtggataagctacaagaggtagtacctaaagatcaacagcctgaacttctggaaaagctctctcagggtaactttacgttgagaattatgtacgaccagttccagaacatactgaacatgggtccacttaaggaggttttctcaatgctgcctggaattagtgctgaaatgatgccgaaaggacatgagaaagaaagccaggcgaagataaagcggtacatgacaatgatggattctatgacaaatgatgaactggacagctcaaacccaaaggtgtttaacgagtcacggatgatgcggatagcaagagggtcagggaggcaagtaagagaagtgatggagatgttggaagagtacaagaggctagcgaagatatggagcaagatgaaaggactcaagatcccaaagaatggagatatgagtgcactctcgagaaacatgaacgcacagcacatgagcaaggtcctcccacctcagatgctcaagcagattggcggcatgggcggtctgcagagtctaatgaagcagatgggttccggcaaggacatgatgggaatgttcggtggcggagacaagtag

SEQ ID NO: 14178 - protein, 495 aa, Arabidopsis thaliana
MVLAELGGRITRAIQQMSNVTIIDEKALNECLNEITRALLQSDVSFPLVKEMQSNIKKIVNLEDLAAGHNKRRIIEQAIFSELCKMLDPGKPAFAPKKAKASVVMFVGLQGAGKTTTCTKYAYYHQKKGYKPALVCADTFRAGAFDQLKQNATKAKIPFYGSYTESDPVKIAVEGVDTFKKENCDLIIVDTSGRHKQEASLFEEMRQVAEATKPDLVIFVMDSSIGQAAFDQAQAFKQSVAVGAVIITKMDGHAKGGGALSAVAATKSPVIFIGTGEHMDEFEVFDVKPFVSRLLGMGDWSGFVDKLQEVVPKDQQPELLEKLSQGNFTLRIMYDQFQNILNMGPLKEVFSMLPGISAEMMPKGHEKESQAKIKRYMTMMDSMTNDELDSSNPKVFNESRMMRIARGSGRQVREVMEMLEEYKRLAKIWSKMKGLKIPKNGDMSALSRNMNAQHMSKVLPPQMLKQIGGMGGLQSLMKQMGSGKDMMGMFGGGDK

SEQ ID NO: 14179 - DNA, 1482 bp, Hordeum vulgare
  CDS (1)..(1482)
atggtgctcgcggacgtcggcgggagcatctcccgcgcgctggcgatgagcagcgcagcggtggtcgacgagagcgtgctccgggagtgcctcaacgagatcgcgcgggcgctcatgcagtccgacgtccggttcaagacggtctgcgacctgcaggccaacatcaggaagaccgtcaacctcgaggccctcgccgccggcaccaacaagcgccgcattatagagacctccgtcgggaaggagctctgcaagatgctggataccgggaagcccgccttcgtccccaagaagggcaagcccaacgtcgtcatgttcgtcggattgcaaggctctggaaaaacaaccacctgtaccaagtacgcgcactatcatcagcgcaagggatttaagccgtcgctggtttgcgccgacacgttcagagccggtgcttttgatcagttgaagcagaacgcaaccaaggccaagatacccttttacggaagctacatggagtcagatcctgtcaagattgctgttgagggcctggaaaagttcaggcaagagaaatctgatctcattatcatcgacacgagtgggcgccatatgcaggaggctgcactcttcgaggagatgcgccaagttgctgaagcaacgaaaccagacctggtgatatttgtgatggatggcagcattggtcaggctgcctttgatcaggcacaggcattcaaacagagtgcttccgttggtgctgtgattgtcacgaaattggatggtcatgcgaagggaggcggtgcactgagcgcggttgcagctacgaaaagcccggtgatattcattggaactggagaacacattgatgattttgacgtttttaacgtggaaccattcgtcgcccgtctgctaggtagaggagacttgcctggcttaatcgacaagatggagagtattgtgcctgctgatcaacaatctgagcttgtggcaaagctgtctgaaggagccttcactctcagacttctgtatgagcaattccagaatcttctgaaaatgggaccaatgagccagatcttctccatgctgcctgggtttagctcggagttgatgccaaaaggacaggagaaacaaagcaaagaaaagttcaagcggtacatgacaattatggactccatgacacctgcagagctcgacagcacgaacccgaagctgatgaccgagtcgcgaatcatccgggtcgctcgagggtccggcaggaaagtcaaggacgtgatggagatgctggaagagtacaagcgactagccaagatgtggagcaagcgtaatgtgtcgaaattgataccgcagaatggaaagatgagtgctcaggccatccagaagatgctcaaagtcatgccgccacaagtggtgcagcagatggggggcaaaagtggcttggaggctctcctgaaacaattgggcggaggcaaggacacgagcaaaatgcttgctggcatgaggggtggtgcttag

SEQ ID NO: 14180 - protein, 493 aa, Hordeum vulgare
MVLADVGGSISRALAMSSAAVVDESVLRECLNEIARALMQSDVRFKTVCDLQANIRKTVNLEALAAGTNKRRIIETSVGKELCKMLDTGKPAFVPKKGKPNVVMFVGLQGSGKTTTCTKYAHYHQRKGFKPSLVCADTFRAGAFDQLKQNATKAKIPFYGSYMESDPVKIAVEGLEKFRQEKSDLIIIDTSGRHMQEAALFEEMRQVAEATKPDLVIFVMDGSIGQAAFDQAQAFKQSASVGAVIVTKLDGHAKGGGALSAVAATKSPVIFIGTGEHIDDFDVFNVEPFVARLLGRGDLPGLIDKMESIVPADQQSELVAKLSEGAFTLRLLYEQFQNLLKMGPMSQIFSMLPGFSSELMPKGQEKQSKEKFKRYMTIMDSMTPAELDSTNPKLMTESRIIRVARGSGRKVKDVMEMLEEYKRLAKMWSKRNVSKLIPQNGKMSAQAIQKMLKVMPPQVVQQMGGKSGLEALLKQLGGGKDTSKMLAGMRGGA

SEQ ID NO: 14181 - DNA, 1326 bp, Aeropyrum pernix
  CDS (1)..(1326): transl_table=11
atgatggagggtgttagaagggctgtagccaagttcctaagagggggaggggtctacgagaaggcggtggacgctttcgtcaaggacctgcagagggagctcataaaggcggatgttaacgtgaagctagtgttgaacgttacgaggaggattaaggagcgagcactcaaggaagagcctcccccgggggttactaggagggattggatgataaagattgtatacgaggagctggtaaagcttttcggcggtgatcaggagccccaggtcgaccctcctaagaccccgtggattgttctgctggtgggtgtacaggggtcggggaagacgacgaccgcaggcaagctggcgtactactacgtcaggcgcggctataaagtgggcctggtcagcagcgacactcaccggccgggtgcttatgagcagctcaagaggctggcggaggaggctggggcaatgttttacggggagagggagggcgaccccgccgagatagccaggaggggtctagaagatcttctaagccgcggcgccgagatagtgatagtagacacggctggccgccacggacacggcgaggaggccaggctccttgatgagatgaaggctatagcctccaaggtgaggcctgacgaggtcgcgctagtcatagacgcgagcataggccagaaggctatgggcctcgcggagaggttccacaagtcaacccctataggtagcataatcgtaacgaaaatggacggaacagcccgcggaggcggcgccctgaccgcagccgccgttacgggggcccggataaagttcataggcacgggcgagacgctaggagagctagagcccttcgcccccagacgcttcgtagccaggatactgggtatgggcgatttagagagcctgctcgagaggataaagagtcttgaggaggcaggcgagcttgacagggctgccgaggatgtgttgaaggggaggataacgatgcgcaccatatataggcagctcagggctatgaggaagctgggccccctgggaaaggtcctccagatgctacccggggcctccatgctggctagcattgacgagggtgcgctgaagctgggggaggagaagatgaagaggtggatggctataatagagagcatgacatatgaggagcttgacaggccggagatcattgacaagaggaggatgaggaggatagctataggtagcggtacgagcgtggatgacgtcagggagcttcttgtgtactacaagaaccttaagactatgatgaagaagctgaagcgcgataaacgcctgctcaggaggctcggcatggagctatag

SEQ ID NO: 14182 - protein, 441 aa, Aeropyrum pernix
MMEGVRRAVAKFLRGGGVYEKAVDAFVKDLQRELIKADVNVKLVLNVTRRIKERALKEEPPPGVTRRDWMIKIVYEELVKLFGGDQEPQVDPPKTPWIVLLVGVQGSGKTTTAGKLAYYYVRRGYKVGLVSSDTHRPGAYEQLKRLAEEAGAMFYGEREGDPAEIARRGLEDLLSRGAEIVIVDTAGRHGHGEEARLLDEMKAIASKVRPDEVALVIDASIGQKAMGLAERFHKSTPIGSIIVTKMDGTARGGGALTAAAVTGARIKFIGTGETLGELEPFAPRRFVARILGMGDLESLLERIKSLEEAGELDRAAEDVLKGRITMRTIYRQLRAMRKLGPLGKVLQMLPGASMLASIDEGALKLGEEKMKRWMAIIESMTYEELDRPEIIDKRRMRRIAIGSGTSVDDVRELLVYYKNLKTMMKKLKRDKRLLRRLGMEL

SEQ ID NO: 14183 - DNA, 1302 bp, Archaeoglobus fulgidus
  CDS (1)..(1302): transl_table=11
atggctcttgaatctctcaaggaagttgcaaggaaaattgcggggtcatcgagcattgataagaaattcgtcgaggagatggttaaggagatacagagagccctcatcaaggctgatgtcaatgtcaggcaggttaaggaaatcagcgatgcgataaagaaaagggctctaagcgaggacgttcttcccgctctcaacgcaaaggagcagattctcaaaatcgtttacgaggagttgctcaggggagtgggagaggggcttgagataccgctgaaaaaggccaagattatgctcgtcggtcttcaggggagcggtaagaccacaacaacggccaaaatggccaaatacttcaaagacagggggatgaaggttgctgttgttgcagccgacacatggagacctgcagcctacgagcagctaaggcagcttgcggaggagtacggaataacgttctacggcgagaagggggaaaaagatgcggtcaaaatagtcaaaaacgcgctggaaaagctcaaagaccacgacatgataatcatagacacagccggaaggcatgcgctcgaagatgagctgattgatgagatgataaagattgcagaggttgcgaggccggactacaagctgctcgtgcttgatgcagcgataggccagcttgcaagcaagcaagctcaggcgtttcacgaggctataggaatcaatggcataatcatcacgaagttcgatggaacggcgaagggtggtggtgctttgtcggcagcgaggcagattggaataccgatagcattcataggaacgggagagaaggtggaggacttcgaacgctttgatcccgctggcttcgtttcgagactgcttggaatgggagatatcaaggcgctaatggagaagattgagaggattgcaagcgaggaggagctagatcctgaagcattcctgaagggaaccttcacgctgaaagacatttacaagcagatagaggcaatgaacaaaatggggccggttagaaagattttcgagatgctcccctttggcctgggattgaaggttgataatgacgtaatggagatgacgcaggagaaaatgaagaaattcagagtgattatggattcgatgactgaggaggagttgctgaatccaaaaatcatcgattcttcgaggataaggaggatagcaatcgggagcggaacctctcctcaggaggtcaaggagcttctgaactactacaagacgatgaagaaccttatgaagaagatgaagaagaacaagctgccaataaagggtctggggaagctgggtttctga

SEQ ID NO: 14184 - protein, 433 aa, Archaeoglobus fulgidus
MALESLKEVARKIAGSSSIDKKFVEEMVKEIQRALIKADVNVRQVKEISDAIKKRALSEDVLPALNAKEQILKIVYEELLRGVGEGLEIPLKKAKIMLVGLQGSGKTTTTAKMAKYFKDRGMKVAVVAADTWRPAAYEQLRQLAEEYGITFYGEKGEKDAVKIVKNALEKLKDHDMIIIDTAGRHALEDELIDEMIKIAEVARPDYKLLVLDAAIGQLASKQAQAFHEAIGINGIIITKFDGTAKGGGALSAARQIGIPIAFIGTGEKVEDFERFDPAGFVSRLLGMGDIKALMEKIERIASEEELDPEAFLKGTFTLKDIYKQIEAMNKMGPVRKIFEMLPFGLGLKVDNDVMEMTQEKMKKFRVIMDSMTEEELLNPKIIDSSRIRRIAIGSGTSPQEVKELLNYYKTMKNLMKKMKKNKLPIKGLGKLGF

SEQ ID NO: 14185 - DNA, 1605 bp, Aspergillus niger
  CDS (1)..(1605)
atggtccttcaggatctcgggcggcgaatcaacgccgccgtcaatgacctgactcgctctaacaatttggacgagaagcaggcctttgatgacatgatcaaagagatctgcgccgccttgctgtccgccgacgtcaacgtccgcctggtccagtccctccgcaaatccatcaagtccagcgtcaactttgcctctcttcctcccgccgtgaacaagaagcgtttgattcagaaggccgtcttcgatgagctggtttccctggttgatccccatgcggagccattccgtcccaagaagggccgctccaacgtgatcatgttcgtcggtctacagggtgccggtaaaaccaccacctgtaccaagctggcccgccactatcagatgcgcggcttcaagaccgccctcgtctgtgccgataccttccgagctggtgctttcgaccagctgaaacagaatgccaccaaggccaagatcccctactacggtagcctgacgcaaaccgaccccgccatcgtggcagccgagggtgtggccaagttcaagaaggagcgtttcgaaatcatcattgtcgataccagtggtcgtcataagcaggaagaagagctcttcaccgaaatgacccagattcagaccgccgtcacccccgaccagaccatcctcgtcctcgacagcaccatcggtcaggctgccgaagcccagtcctccgccttcaaggccaccgcagacttcggagccatcatcatcaccaagacggatggtcacgccgcaggtggtggtgctatttccgccgtcgccgccacacacactcccattatctacctcggtaccggtgagcacttgatggacctggaacgtttcgagcccaaggccttcatccagaagctcctgggtatgggtgatatggccggactggtagagcacgtacaagccgtgaccaaggactcggcctccgccaaggaaacatacaagcacatctcagaaggtatctacacgctgcgcgacttccgcgagaacatcacctccatcatgaagatgggtcctctctccaagctctccggcatgattcccggtctctccaacctgaccgcgggacttgatgacgaagacggctccatgaagctccgccgcatgatctacattttcgacagcatgacggccgccgaactcgacggcgacggcaagatgttcgtcgaacagcctagccgcatggtccggatcgcttgcggaagcggtaccaccgtccgcgaagtcgaagacctgctctcccagcaccgcatgatggctggtatggccaagcgcgtcggcggacagaagaagcagatgcagcgtgcccagaacatgctcaagggcggtaacaaggaacagcagctcgccgccatgcagaagcgcatggccgccatgggtggtgctggcggtggtggattccccggtatgcccggcatgggcgacatggccaagatgatgcaaatgctgcaaggtcaaggaggtggcggcggtggtggtcttcccggcctgggtgggatggacctacaaagtatgatgagccagatgagtggattgatgggcggtggcggtggtggtggtggccgcggtagaggacggtga

SEQ ID NO: 14186 - protein, 534 aa, Aspergillus niger
MVLQDLGRRINAAVNDLTRSNNLDEKQAFDDMIKEICAALLSADVNVRLVQSLRKSIKSSVNFASLPPAVNKKRLIQKAVFDELVSLVDPHAEPFRPKKGRSNVIMFVGLQGAGKTTTCTKLARHYQMRGFKTALVCADTFRAGAFDQLKQNATKAKIPYYGSLTQTDPAIVAAEGVAKFKKERFEIIIVDTSGRHKQEEELFTEMTQIQTAVTPDQTILVLDSTIGQAAEAQSSAFKATADFGAIIITKTDGHAAGGGAISAVAATHTPIIYLGTGEHLMDLERFEPKAFIQKLLGMGDMAGLVEHVQAVTKDSASAKETYKHISEGIYTLRDFRENITSIMKMGPLSKLSGMIPGLSNLTAGLDDEDGSMKLRRMIYIFDSMTAAELDGDGKMFVEQPSRMVRIACGSGTTVREVEDLLSQHRMMAGMAKRVGGQKKQMQRAQNMLKGGNKEQQLAAMQKRMAAMGGAGGGGFPGMPGMGDMAKMMQMLQGQGGGGGGGLPGLGGMDLQSMMSQMSGLMGGGGGGGGRGRGR

SEQ ID NO: 14187 - DNA, 1671 bp, Candida albicans
  CDS (1)..(1671): transl_table=12
atggttttagcagatttaggatcaagattgaggggtgctttgtcatctgtggaatctggttctgatgacgagatccagcaaatgataaaagatatctgttcagcacttttagaatcagacgtcaatgttaaattagttgccaagttgagaggcaatatcaaaaataaaatcgacgaatccaatgtatctaaagaaacttcagctatgaataaacgtaaaaaattacaaaagatcattttcgacgaattgtgtgcgttagttgactccaatgtcgaacctccaaaaccaaagaaactttctacatcaaccaaaactatcaatgggaaaaaagtgagattgtcaaaagaatcaagtcacgttattatgtttgttggtttgcagggtgcgggtaaaaccacgtcatgtaccaaattggctgtctattataagaagagaggattcaaagttggtttagtgtgtgccgatactttcagagctggtgcttttgatcagttgaagcagaatgccataaaggcaaatataccttactatggttcgtatttggaaccagatccagttaagattgcatttgaaggggttcaaaaattcaaacaagagaaattcgatattataattgtcgatacttcaggaagacatagacaagaagaacaattgtttacagaaatggttcaaattggagaagctgtccaaccaacccaaaccataatggtgatggatggatctataggtcaagctgcagaatcacaagctcgtgcatttaaagaaagttctaattttgggtcaatcatattaaccaaaatggatggtcatgccaaaggaggtggtgctatttctgctgttgcagctacaaagacaccaattgtcttcataggtactggtgagcatgtgggtgatttagagattttcaaaccaaccacatttatttcaaaacttttaggtattggtgatattcaaggtttaattgaacatgttcagtcattgaatttgcaccaagacgaaggacataaacaaacaattgaacatataaaggaaggtaaattcacattgagagatttccaaaatcaaatgaacaatttcttgaaaatgggaccattaacaaatatagcatcgatgattcctggtctttccaatataatgtcacaagtgggagacgaagaaacatcgaaaaagatcaaaaatatgatttatatcatggattcaatgaccaccaaagaactagaatgtgatggtagaatattcataaaggaaccaagcagaatcgtcagagtagcgagaggttctgggtgtgctgttgtcgaagtggagatgatattacaacaacatagaatgatgtcaactatggccaaatctgccatggctgcacaaggtggtcaaccaggccaaccaggaaacccaatggccaacaatccacaaatgcaaagaatgatgcaacaggctcaatcaaacccaaattttatgcaacaagccatgaatatgttaggaggcgccggtggcggtgctggtggcgctgggggattagctggaatgatgaacaaccctgctatgatgcaacaagcacaacagatgatgagactgaatcctcaaatgatgcaacaggctcaacaaatgatgaaaaatccaggaatgatgcaaaagatgatgcaacagtttggtggtatgggtggtatgtaa

SEQ ID NO: 14188 - protein, 556 aa, Candida albicans
MVLADLGSRLRGALSSVESGSDDEIQQMIKDICSALLESDVNVKLVAKLRGNIKNKIDESNVSKETSAMNKRKKLQKIIFDELCALVDSNVEPPKPKKLSTSTKTINGKKVRLSKESSHVIMFVGLQGAGKTTSCTKLAVYYKKRGFKVGLVCADTFRAGAFDQLKQNAIKANIPYYGSYLEPDPVKIAFEGVQKFKQEKFDIIIVDTSGRHRQEEQLFTEMVQIGEAVQPTQTIMVMDGSIGQAAESQARAFKESSNFGSIILTKMDGHAKGGGAISAVAATKTPIVFIGTGEHVGDLEIFKPTTFISKLLGIGDIQGLIEHVQSLNLHQDEGHKQTIEHIKEGKFTLRDFQNQMNNFLKMGPLTNIASMIPGLSNIMSQVGDEETSKKIKNMIYIMDSMTTKELECDGRIFIKEPSRIVRVARGSGCAVVEVEMILQQHRMMSTMAKSAMAAQGGQPGQPGNPMANNPQMQRMMQQAQSNPNFMQQAMNMLGGAGGGAGGAGGLAGMMNNPAMMQQAQQMMRSNPQMMQQAQQMMKNPGMMQKMMQQFGGMGGM

SEQ ID NO: 14189 - DNA, 1383 bp, Halobacterium salinarium
  CDS (1)..(1383): transl_table=11
atggtactcgacgaccttgggagctcgctgcggggcaccttggacacgctccgcgggaagtcccgcatctccgaggaggacgtcgacaaggtcgtcaaggagattcagcgctccttgctgcaggccgacgtcgacgtggacctcgtgatggatctctccgagtcgatcacggagcggtcgcttgaggaggagccgccgggcggaacgagcgcccgcgatcacgtgttgcgcatcgtctacgaggaactcgtcgggctcgtgggtgattcgacgccgatccccctggaggagcagacgatcatgctggcgggcctgcaggggtcggggaagacgaccacggccgcgaagatggcgtggtggttctcgaagaaggggctgcggccggcgatcgtgcagacggacacgttccggccgggggcctacgagcaggccgcggagatggccgaccgcgcggaggtcgatttctacggggagccggacagcgacgatcccgtgcagatcgcccgcgacgggcttgcagcgacggcggacgccgacgtgcatatcgtggacacggcgggccgccacgcgctggaggacgacctcatcgcggagatcgaggagatcgagggcgtcgtcgagccggaccggagcctgctggtgttggacgccgcgatcgggcagggggccaaacagcaggcccggcagttcgacgcgtcgatcggcatcgacggggttgcgatcacgaagctcgacggaaccgcgaagggcggcgggtcgctgacggccgtgaacgagaccgactccaccatcgcgttcctgggctccggggagaccgtccaggacatcgagcgcttcgagccggattcgttcatctcgcggttgctggggatgggggatctcaagcagctcaccgagcgcgtggagcgcgcgatggaggaaacccaggacgacgacgaggactgggaccccgaggacctcatgaagggggagttcaccctccacgacatgcgaaagcagatgcaggcgatggacaacatggggccactggatcaggtgatggacatgatccccggcatggggggtgggttgatggacgagctccccgacgacgcgatggacgtcacccaggagcgcatgcggggcttcgaggtcatcatggattcgatgaccgaggcggagatggccgacccgcgttcggtgggggcgtcacagatccggcgcatcgcgcgcgggtccgggcagcccgaggaccgcgttcgggagctgctcgaccagcacaagatgatggcgcagacgatgcagcagttccagggcatgggtgacggggacatgcagcgcatgatgtcgaagatgcaacagcagggcggtggcggcggtggcgggttcggcggcatgttctga

SEQ ID NO: 14190 - protein, 460 aa, Halobacterium salinarium
MVLDDLGSSLRGTLDTLRGKSRISEEDVDKVVKEIQRSLLQADVDVDLVMDLSESITERSLEEEPPGGTSARDHVLRIVYEELVGLVGDSTPIPLEEQTIMLAGLQGSGKTTTAAKMAWWFSKKGLRPAIVQTDTFRPGAYEQAAEMADRAEVDFYGEPDSDDPVQIARDGLAATADADVHIVDTAGRHALEDDLIAEIEEIEGVVEPDRSLLVLDAAIGQGAKQQARQFDASIGIDGVAITKLDGTAKGGGSLTAVNETDSTIAFLGSGETVQDIERFEPDSFISRLLGMGDLKQLTERVERAMEETQDDDEDWDPEDLMKGEFTLHDMRKQMQAMDNMGPLDQVMDMIPGMGGGLMDELPDDAMDVTQERMRGFEVIMDSMTEAEMADPRSVGASQIRRIARGSGQPEDRVRELLDQHKMMAQTMQQFQGMGDGDMQRMMSKMQQQGGGGGGGFGGMF

SEQ ID NO: 14191 - DNA, 1398 bp, Halobacterium volcanii
  CDS (1)..(1398): transl_table=11
atggtactcgacaatctcgggagttccctccgcggcagtctcgataaactgcgcgggaagtcccgcctcgacgaggacgacgttcaggagatcgtcaaggagattcagcgctccctgctctccgccgacgtcgacgtcagcctcgtcatggacctctcggactctatcaagacccgcgcgctggaagaggagccgccgggcggcacgagcgcgcgcgaccacgtcctgaaaatcgtctacgaggaactcgtcgacctcatcggtgagtcgacggagattccgctcgaatcgcagaccatcatgctcgccggcctccaggggtcggggaagacgaccacctccgccaagatggcgtggtggttctcgaagaaggggcttcgccccgcggtcatccagaccgacaccttccgccccggcgcgtacgaccaggccaagcagatgtgcgagcgcgccgaggtcgacttctacggcgaccccgactgcgacgacccggtccaaatcgcccgcgagggcctcgaagcgaccgaggacgccgacgtgcacatcgtcgacacggccggtcgccacgcgctcgaagacgacctcatcgacgaaatcgaggagatagagggcgtcgttcagcccgacctgaacctgctcgtcctcgacgcggcaatcgggcaaggggcgaaggaacaggcccagcagttcgacgagtccatcggcatcggcggcgtcgtcatcaccaaactcgacgggacggcgaagggtggcggcgcgctgaccgccgtcaacgagaccgactcgtctatcgccttcctcggcatgggcgagacggtccaggacatcgagcgcttcgagccgaacggcttcatctctcggctgctcggcatgggcgacctgaaacagctctccgagcgcgtcgaacgcgccatgtccgagacccaggccgaagacgaggactgggatcccgaggagatgatgaaggggaacttcaccctcaaggacatgcaaaaacagatggaggcgatggacaagatggggccgctcgaccaggtgctcgacatgattccgggcttcggcggcggcatcaaagaccagcttccggacgacgcgatggacgtgaccaaagaccggatgcgttcgttcgaggtcatcatggactcgatgactgaggaggaactggagaacccccggaaggtcggcgcgtcccgcgtcaggcgcatcgcgcaggggtcgggacaggacgaggagacgattcaggaactgctcgaacagcaccgcatgatggaacagaccatcaagcagttccagaacatgggcgacggcgacatgcagcggatgatgaagaagctccagaaccagggtggcggcggcggtggcggcatgggcggtctcggcggcatggggccgttctga

SEQ ID NO: 14192 - protein, 465 aa, Halobacterium volcanii
MVLDNLGSSLRGSLDKLRGKSRLDEDDVQEIVKEIQRSLLSADVDVSLVMDLSDSIKTRALEEEPPGGTSARDHVLKIVYEELVDLIGESTEIPLESQTIMLAGLQGSGKTTTSAKMAWWFSKKGLRPAVIQTDTFRPGAYDQAKQMCERAEVDFYGDPDCDDPVQIAREGLEATEDADVHIVDTAGRHALEDDLIDEIEEIEGVVQPDLNLLVLDAAIGQGAKEQAQQFDESIGIGGVVITKLDGTAKGGGALTAVNETDSSIAFLGMGETVQDIERFEPNGFISRLLGMGDLKQLSERVERAMSETQAEDEDWDPEEMMKGNFTLKDMQKQMEAMDKMGPLDQVLDMIPGFGGGIKDQLPDDAMDVTKDRMRSFEVIMDSMTEEELENPRKVGASRVRRIAQGSGQDEETIQELLEQHRMMEQTIKQFQNMGDGDMQRMMKKLQNQGGGGGGGMGGLGGMGPF

SEQ ID NO: 14193 - DNA, 1323 bp, Methanosarcina acetivorans
  CDS (1)..(1323): transl_table=11
atggtaatggaaaaactcggagactccttacagggggcactcaagaaactgatcggcgcggggagaattgatgagcgcacggtcaatgaagtagtaaaagacattcagagggctttgctccaggccgatgttaacgtaaaacttgtcatggggatgtcccagaggattaaagaacgtgcaatgaaagaagaaccgcctgcgggtatgaatccgagggagcacgtaatccgcatcgtgtaccaggaactgatggaaatcatagggaagggggcggagatccagctcaaaccccagaccatcatgatggtggggctgcaggggagcggaaaaaccacaagtgctgcaaaacttgcccgctatttccagagaaaaggacttaaagcaggtgttgttgccgcagatactttcaggcccggagcttaccaccagctcaagactctcgctgaaaaactcaatgtgggtttttatggagaagaaggaaatcccgatgctgtcgagattaccaaaaacgggcttaaagcccttgaaaaatacgatataagaatagtggatactgcaggcaggcatgcccttgaagccgacctgatagaagaaatggaacggatccatgctgttgcaaaacccgaccacaagttcatggttctggatgcaggcatagggcagcaggcaagccagcaggcacatgctttcaacgactctgtgggaatcacaggagttatcatcacaaaactggacgggacagcaaaaggtggcggagccctttcagccgtttccgaaacaaaggctccgattgcttttatcggagttggggaaaccccggaagactttgaaaagttcgaagctgacaggttcatttcaaggctgctcggaatgggagacctcaagagcctgatggaaaaagctgaagagagcctgagcgaagaagacgtaaatgtcgaagccctgatgcagggacgcttcacccttaaggatatgtacaagcaactcgaagcgatgaacaagatgggccctctcaaacagatcatgtccatgctcccaatgggtatgggaggcatgaagttctcagacgaaatgttccaggctaccagtgacaaaatgaaaaactacaaggtcatcatggactcgatgacagaagaggaaatgacagacccaagggtcataggcggatcaaggatcaagaggatctcgaagggttcgggctgcagctcagaggacgtaagggagcttctgaaataccacaaaaccatgcagacggctttaaaaggcttcagaggaggaaaattcaatattcagaaaatgatgaagaagaaaatggggatgtaa

SEQ ID NO: 14194 - protein, 440 aa, Methanosarcina acetivorans
MVMEKLGDSLQGALKKLIGAGRIDERTVNEVVKDIQRALLQADVNVKLVMGMSQRIKERAMKEEPPAGMNPREHVIRIVYQELMEIIGKGAEIQLKPQTIMMVGLQGSGKTTSAAKLARYFQRKGLKAGVVAADTFRPGAYHQLKTLAEKLNVGFYGEEGNPDAVEITKNGLKALEKYDIRIVDTAGRHALEADLIEEMERIHAVAKPDHKFMVLDAGIGQQASQQAHAFNDSVGITGVIITKLDGTAKGGGALSAVSETKAPIAFIGVGETPEDFEKFEADRFISRLLGMGDLKSLMEKAEESLSEEDVNVEALMQGRFTLKDMYKQLEAMNKMGPLKQIMSMLPMGMGGMKFSDEMFQATSDKMKNYKVIMDSMTEEEMTDPRVIGGSRIKRISKGSGCSSEDVRELLKYHKTMQTALKGFRGGKFNIQKMMKKKMGM

SEQ ID NO: 14195 - DNA, 1356 bp, Methanococcus jannaschii
  CDS (1)..(1356): transl_table=11
atgctcgataaattaggagaaaatttaaacaaagccctaaacaaactaaaagctgctgcctttgttgataaaaaattaataaaagaagttataaaagatattcaaagggctttaatacaggcagatgttaatgtaaaattggttttaaagatgagtaaagaaatagagaggagagctttagaggaaaagacaccaaagggtttatcaaagaaagagcatatcataaagattgtctatgaagaattagtcaaattattgggagaagaggcaaaaaaattagagttaaatccaaaaaaacaaaatgttatcttattagttggtattcaaggttcaggaaaaacaacaactgcagcaaaattagcaaggtatatccaaaaaagagggttaaaacctgctttaatcgcagctgatacctacagaccagcggcttatgagcagttaaagcagttagctgaaaaaatccacgtgccaatatatggggatgagacaagaacaaaatcaccagtagatattgttaaagaggggatggagaaatttaagaaggcagatgttttaattatagatactgctggaagacataaagaggaaaaaggtttattggaagagatgaagcaaattaaagagataacaaatccagatgaaatcatattggttatagatgggactattgggcaacaagcaggaattcaagctaaagcgtttaaagaggcagttggagagattgggagtataatagtaactaagttagatggttctgctaaaggaggaggggcgttaagtgcggttgctgagacaaaagcacctataaaattcattggaattggggaggggattgatgatttagaaccattcgaccctaaaaaatttatatctcgactgttagggatgggagatttagagagcctattagaaaaagctgaagacatggttgatgagaaaacagaagaaagcatagatgcaataatgagagggaaatttactttaaatgagttgatgactcaattagaagcaattgaaaacatgggttcaatgaaaaaaatcctaagtatgattcctggatttggaggagctatgcctaaagagctttctcatttaactgaggcaaagataaaaaaatataaggtaattataagttcaatgactaaggaagagagagaaaatccaaagattattaaagcttcaagaatcagaaggattgcaagaggttctggaactacagaaaatgatgttagggaggttttaagatattatgaaacaacaaaaaatgccatagataagttgagaaagggtaagatgttgagaattggaggacctttaggacaaataatgagacaattaatgtttaaggaaggataa

SEQ ID NO: 14196 - protein, 451 aa, Methanococcus jannaschii
MLDKLGENLNKALNKLKAAAFVDKKLIKEVIKDIQRALIQADVNVKLVLKMSKEIERRALEEKTPKGLSKKEHIIKIVYEELVKLLGEEAKKLELNPKKQNVILLVGIQGSGKTTTAAKLARYIQKRGLKPALIAADTYRPAAYEQLKQLAEKIHVPIYGDETRTKSPVDIVKEGMEKFKKADVLIIDTAGRHKEEKGLLEEMKQIKEITNPDEIILVIDGTIGQQAGIQAKAFKEAVGEIGSIIVTKLDGSAKGGGALSAVAETKAPIKFIGIGEGIDDLEPFDPKKFISRLLGMGDLESLLEKAEDMVDEKTEESIDAIMRGKFTLNELMTQLEAIENMGSMKKILSMIPGFGGAMPKELSHLTEAKIKKYKVIISSMTKEERENPKIIKASRIRRIARGSGTTENDVREVLRYYETTKNAIDKLRKGKMLRIGGPLGQIMRQLMFKEG

SEQ ID NO: 14197 - DNA, 1332 bp, Methanosarcina mazei
  CDS (1)..(1332): transl_table=11
atggtaatggaaaaactcggagactccttacagggagcactcaaaaagctgatcggcgcagggagaattgatgagcgcacggtcaatgaagtagtaaaggatattcagcgcgctctgctccaggctgacgttaacgtaaaacttgtcatggggatgtcgcagagaatcaaagagcgtgcaatgaaagaagaccctcctgcgggtatgaacccgagggagcatgtgatccgcattgtgtatcaggaactgatggaaatcatcgggaaaggagccgatatccagctcaagccccagacaatcatgatggtgggacttcagggaagcggaaagaccacaagtgctgcaaaactggcacgctatttccagagaaaggggctcaaagcaggtgttgttgccgcagataccttccggccaggagcttaccaccagctcaagactctctctgaaaagctcaatgtgggtttttacggagaggaaggaaaccccgatgctgtagagattaccatacatgggcttaaagcactcgaaaaatacgatataaaaatagtggacacagcaggcaggcacgccctcgaagccgaccttatcgaagaaatggagaggatccatgccgttgcaaaacctgaccacaagttcatggttctcgacgcgggtatagggcaacaggcaagccagcaggctcatgctttcaatgattcggtagggatcacgggcgttatcatcacaaaactggacggaacagcaaaaggtggtggagcgctttcagcagtatctgaaacaaaagctccgattgcctttataggagtaggggaaactccggaagactttgaaaagttcgaggctgacaggttcatctcaagacttcttggaatgggggacctcaagagcctgatggaaaaggcagaggaaagcctgagcgaagaagacgtcaatgtcgaagcccttatgcaggggcgcttcacattgaaagatatgtacaagcagcttgaagcaatgaataaaatgggccctctcaagcagattatgtcaatgctccctatgggcatgggaggactgggaggcgtgaaattatcagatgagatgttccaggctaccagtgacaaaatgaagaattacaaggtcattatggactcgatgacagaagatgaaatggctgaccccaagctaataggcggatcacggatcaaaagaatatcaagaggctctggctgcagtcctgaagatgtcagggaacttctaaaatatcataaaaccatgcagacggctttgaaaggcttcagaggcggaaaattcaatatccagaaaatgatgaagaagaaaatggggatgtaa

SEQ ID NO: 14198 - protein, 443 aa, Methanosarcina mazei
MVMEKLGDSLQGALKKLIGAGRIDERTVNEVVKDIQRALLQADVNVKLVMGMSQRIKERAMKEDPPAGMNPREHVIRIVYQELMEIIGKGADIQLKPQTIMMVGLQGSGKTTSAAKLARYFQRKGLKAGVVAADTFRPGAYHQLKTLSEKLNVGFYGEEGNPDAVEITIHGLKALEKYDIKIVDTAGRHALEADLIEEMERIHAVAKPDHKFMVLDAGIGQQASQQAHAFNDSVGITGVIITKLDGTAKGGGALSAVSETKAPIAFIGVGETPEDFEKFEADRFISRLLGMGDLKSLMEKAEESLSEEDVNVEALMQGRFTLKDMYKQLEAMNKMGPLKQIMSMLPMGMGGLGGVKLSDEMFQATSDKMKNYKVIMDSMTEDEMADPKLIGGSRIKRISRGSGCSPEDVRELLKYHKTMQTALKGFRGGKFNIQKMMKKKMGM

SEQ ID NO: 14199 - DNA, 1329 bp, Methanobacterium thermoautotrophicum
  CDS (1)..(1329): transl_table=11
atgcttgggaatctgggcagaagtctcagtaaaactatgaaaaagctggcagggatgacaattgttgatgaggaggtcgtcagggaggtcataaaggatatacagagggccctgatccagtccgatgtcaacataaaacttgtattcaacctgtcaaagtcaattgaggaacgggcactcaacgaggaaccccctaaggggataacgccaaaggagcacatcataagcatagtgtacgatgagatggtcaaactcctgggtgagaagagccatgaacttgtcatagatgataaaccgtaccgcatactcttccttggactccagggtagcggtaaaacaacaaccataggtaaacttgcaaggtacctccgcaagaagggtttcactgttggggtggtctgtacagacacctggcgccctgcggcccttgagcagctgaaacagtataccgagggacaggacgtgagcatatacggcgacccccagaacagggacgccctggaccttgcagagaagggacttgcccggttccagaagaaggacgttatcatattcgatacggccggaagacacaaggaggagaaggacctcctcagggagatggaggaactttcagccattgtggagccccatgaggccatacttgtaatcgacggaaccataggccagcaggcaagggaacaggccctcgcattcagaaaagccacagatataggttcaataattgtgaccaagctcgatggttcagccaagggtggtggggccctctcggccgttgcagagataggtgctcccataaagttcataggtaccggtgagaggatagatgacctggaggtcttcgatcccgaaaggttcatatcacgtctcctgggtatgggggacctcagaagtctcctcgagaaggttgaagaggtttcagaggaggagattgcagaggaatccctcgacgcaatactctcaggtaagttcaccctcagggatatgagggtgcagtttgagatgatgggtaagatggggcccctccagcaggttatgagtatgctgcccggtgccgggaaactcccaaaggacgccagcaggatgaccgaggagaccatacggaagtacctcataataatggactccatgacagaggaggaactggaaaaaccagacatcataaagcactcaagaatacgcaggatagcccggggttcagggacacgcaatgaggacgttaaggagctcctgaagtactacagggtcaccaaaaaggccatgaaggggcttggaaggagaaaaatgggcggacccatgggccagctcatgaggcagttcatgagatag

SEQ ID NO: 14200 - protein, 442 aa, Methanobacterium thermoautotrophicum
MLGNLGRSLSKTMKKLAGMTIVDEEVVREVIKDIQRALIQSDVNIKLVFNLSKSIEERALNEEPPKGITPKEHIISIVYDEMVKLLGEKSHELVIDDKPYRILFLGLQGSGKTTTIGKLARYLRKKGFTVGVVCTDTWRPAALEQLKQYTEGQDVSIYGDPQNRDALDLAEKGLARFQKKDVIIFDTAGRHKEEKDLLREMEELSAIVEPHEAILVIDGTIGQQAREQALAFRKATDIGSIIVTKLDGSAKGGGALSAVAEIGAPIKFIGTGERIDDLEVFDPERFISRLLGMGDLRSLLEKVEEVSEEEIAEESLDAILSGKFTLRDMRVQFEMMGKMGPLQQVMSMLPGAGKLPKDASRMTEETIRKYLIIMDSMTEEELEKPDIIKHSRIRRIARGSGTRNEDVKELLKYYRVTKKAMKGLGRRKMGGPMGQLMRQFMR

SEQ ID NO: 14201 - DNA, 1332 bp, Pyrococcus abyssi
  CDS (1)..(1332): transl_table=11
atggttctagattccctggggaaggcacttagcaatgccctcaagaagatagctagggccggtagcgttgacgaggctttagttaaggaggttgttagggacattcagagggcgcttattcaagctgatgtaaatgtgaggctagtcttgaagctaaccaaggagatacagaggagggccttggaggagaaacctcccgccggaatctcgaagaaggaacacataataaagatagtgtacgaggaactcacaaagttcctgggaaccgaggccaagcccatagagatcaaggagaagcccacaattctgctgatggtaggcgttcagggtagcggtaagacaacgacggttgctaagctagctagacacttccagaagaggggttacaaggtgggcgtagtctgctcggacacttggagaccaggggcgtatcatcagttaaagcaattacttgatccctaccacatagaggtctttggcgatccgaacgagaaggatgcgattaaactagctaaagaaggagttgaacacttcaaggccaagggagttgacttgataatagttgataccgccggaaggcacaaggaagagaaggatctaatagaagagatgaggatgataagcaacgagatcaagccccacgaggttattctagtgatagacggaactatagggcaacaagcttacaaccaagccttggcctttaaggaagcaaccccaataggttcaataatagttaccaagctcgacagctcggccaagggaggaggggctttatctgcagtagcagctactggagccccgataaagttcattggaacaggcgagaagatagatgatttagagccatttgacccagcgagattcgtttcaaggctactcggacttggcgacatccagggattgctcgagaagttcaaggagcttgagaaggaagtggaattcaccgaggaggatctggagaggtttcttaaagggaagttcacgcttaaagacatgtacgcccagctagaggccatgaggaagatggggccactcaagcagatccttagaatgatcccaggattaggatactcccttcccgacgaggtaatctcggtgggcgaagagaggctgaggaagttcaaagtcataatggattctatgacggaggaagagctcatgaacccagatataataaactactccaggataaagaggatcgctaggggatccggaacctcggttaaagatgttaaggagttgttaaatcagtacaatcaaatgaagaagttcttcaagagcatgaataagaggcaactattaaggctcgcaaggaggtttggaatgtga

SEQ ID NO: 14202 - protein, 443 aa, Pyrococcus abyssi
MVLDSLGKALSNALKKIARAGSVDEALVKEVVRDIQRALIQADVNVRLVLKLTKEIQRRALEEKPPAGISKKEHIIKIVYEELTKFLGTEAKPIEIKEKPTILLMVGVQGSGKTTTVAKLARHFQKRGYKVGVVCSDTWRPGAYHQLKQLLDPYHIEVFGDPNEKDAIKLAKEGVEHFKAKGVDLIIVDTAGRHKEEKDLIEEMRMISNEIKPHEVILVIDGTIGQQAYNQALAFKEATPIGSIIVTKLDSSAKGGGALSAVAATGAPIKFIGTGEKIDDLEPFDPARFVSRLLGLGDIQGLLEKFKELEKEVEFTEEDLERFLKGKFTLKDMYAQLEAMRKMGPLKQILRMIPGLGYSLPDEVISVGEERLRKFKVIMDSMTEEELMNPDIINYSRIKRIARGSGTSVKDVKELLNQYNQMKKFFKSMNKRQLLRLARRFGM

SEQ ID NO: 14203 - DNA, 1332 bp, Pyrococcus furiosus
  CDS (1)..(1332): transl_table=11
atggttctagataacctagggaaagcacttgccaacactctaaagaagatagccagagccagcagtgtggatgaagctttaatcaaagagttagttagggatatccagagagctctaattcaagctgacgtaaacgttagactagttcttcaacttacaagagaaatacagagaagagcactggaagagaagcctcctgcaggaatatctaagaaagaacacattataaaaatagtctatgaagagttaacaaaattcctcggaacagaagcaaagccaatagaaatcaaggagaaaccaacaattttgttaatggttggaattcagggaagtggaaaaactacaacggttgcaaaacttgcgagatacttccaaaaaagaggatataaggtcggagttgtatgttcagatacctggagacctggggcttatcaccagcttaggcaacttctagatcgttaccacatagaagtgtttggaaatcctcaagaaaaagatgccataaagttagcaaaagaaggagttgattacttcaaatctaaaggagtagacataataatagtggataccgcgggaaggcacaaagaagacaaggcgttaattgaagagatgaagcaaataagcaacgtaatacatcctcatgaggttatacttgtaattgatggaacaataggacaacaagcatacaaccaggccttagcctttaaagaagcaacaccgattggctccataatagtcacaaagctcgatggatctgccaagggaggaggagccctttctgcagttgccgcaacaggggctccaataaaattcataggtacgggagaaaagatagatgatatcgagccctttgacccaccgagatttgtttcaagactcttgggacttggagatattcaaggattgctggaaaaatttaaggagttagagaaagaagttgaaataaaagaggaagacattgaaagattcttaaggggtaaatttacacttaaggacatgtatgctcagcttgaagcgatgagaaaaatggggcccctaaaacaaatactgagaatgattcccgggctgggatattcccttcccgatgacgtgatctcaatcggagaagagaggctaaagaaattcaaagtaataatggattcaatgacagaggaagaactgctaaatcccgagataataaactattccaggatcaagagaattgcaagaggatcaggaacatctacaaaggatgtaaaagaacttttagatcaatataggcagatgaaaaagttatttaagagcatgaacaagagacaattgagcagacttgccaggaggtttggtatgtaa

SEQ ID NO: 14204 - protein, 443 aa, Pyrococcus furiosus
MVLDNLGKALANTLKKIARASSVDEALIKELVRDIQRALIQADVNVRLVLQLTREIQRRALEEKPPAGISKKEHIIKIVYEELTKFLGTEAKPIEIKEKPTILLMVGIQGSGKTTTVAKLARYFQKRGYKVGVVCSDTWRPGAYHQLRQLLDRYHIEVFGNPQEKDAIKLAKEGVDYFKSKGVDIIIVDTAGRHKEDKALIEEMKQISNVIHPHEVILVIDGTIGQQAYNQALAFKEATPIGSIIVTKLDGSAKGGGALSAVAATGAPIKFIGTGEKIDDIEPFDPPRFVSRLLGLGDIQGLLEKFKELEKEVEIKEEDIERFLRGKFTLKDMYAQLEAMRKMGPLKQILRMIPGLGYSLPDDVISIGEERLKKFKVIMDSMTEEELLNPEIINYSRIKRIARGSGTSTKDVKELLDQYRQMKKLFKSMNKRQLSRLARRFGM

SEQ ID NO: 14205 - DNA, 1332 bp, Pyrococcus horikoshii
  CDS (1)..(1332): transl_table=11
atggttctagattcactaggtagggccctcagtaatgcactaaaaaagatagcaagagctggtagtgttgatgaagctctagttaaagaggttgttagggatattcagagggccctgcttcaagctgacgtcaacgttagattagttctcaagttgactaaggagattcagaggagggccctggaggaaaaacctcctgcgggaatatcaaagaaggagcatataataaagatagtttatgaggaacttacaaagtttctagggactgaagctaagccgatagagattaaggagaagccgactgtacttcttacggttggcgttcagggaagtggtaagacaacaaccgttgctaagctagcgaggtacttccagaaaaggggatataaagtcggagtggtgtgctcagatacctggaggcccggggcctatcaccaattgaaacagctcttagatccgtatcacattgaagtcttcggcgaccccaacgagaaagatgccgtaaaattggccaaagagggcgttgaatactttaagacaagagatgttgatttaataatagtggatacggcggggaggcataaggaagagaaagatcttatcgaggaaatgaggatgataagtgaagagattagacctcatgaagtaatcctcgtcatagatggaaccatagggcaacaagcatacaatcaggccctggcctttaaggaggcgacgccaatagggtcaattattgtgacaaagcttgacagttcagcaaaaggtggaggggcattatccgctgtagctgctactggggccccaataaagttcataggagttggagaaaagatagatgacttggagccctttgatccagctaggtttgtctctagattgcttggccttggagatattcaagggttacttgaaaagtttaaagaacttgaaaaagaggttgaattcaccgaggaagatatagacaggttcctgaggggtaagtttaccctgaaggatatgtatgctcagcttgaagcgatgagaaagatgggcccccttaagcagatacttagaatgatccctggtttgggatactcccttccagatgagctcatatccgtcggtgaggaaagacttagaaagttcaaggtaataatggactcaatgacagaggaagagcttatgaaccctgaaataataaattactccaggataaagagaatcgctagaggatctgggacatcgataaaggatgttaaagaattgctaactcaatataatcagatgaagaagttctttaagagtatgaataagagacaattgtcaagactggcaaggaggtttgggatgtga

SEQ ID NO: 14206 - protein, 443 aa, Pyrococcus horikoshii
MVLDSLGRALSNALKKIARAGSVDEALVKEVVRDIQRALLQADVNVRLVLKLTKEIQRRALEEKPPAGISKKEHIIKIVYEELTKFLGTEAKPIEIKEKPTVLLTVGVQGSGKTTTVAKLARYFQKRGYKVGVVCSDTWRPGAYHQLKQLLDPYHIEVFGDPNEKDAVKLAKEGVEYFKTRDVDLIIVDTAGRHKEEKDLIEEMRMISEEIRPHEVILVIDGTIGQQAYNQALAFKEATPIGSIIVTKLDSSAKGGGALSAVAATGAPIKFIGVGEKIDDLEPFDPARFVSRLLGLGDIQGLLEKFKELEKEVEFTEEDIDRFLRGKFTLKDMYAQLEAMRKMGPLKQILRMIPGLGYSLPDELISVGEERLRKFKVIMDSMTEEELMNPEIINYSRIKRIARGSGTSIKDVKELLTQYNQMKKFFKSMNKRQLSRLARRFGM

SEQ ID NO: 14207 - DNA, 1347 bp, Pyrococcus kodakaraensis
  CDS (1)..(1347): transl_table=11
atggcacttgagaagctcggccaagcactgaacagcgctctcaaaaaactcgcccgttcgagcaccgttgatgaggccacgatcaaagagattgtgagggatatccagagggcactactccaggcagacgttaacgtcaagctcgtccttcagttaacaaagcagatacaaaagcgggcgctcgaagaagaacctcccgcaggtgtcagtaagaaggagcacataataaagatcgtgtacgaagaactaaccaagtttctcggaaccgaggcaaagcccctcgagataaagcacaagccgaccgttatcctcacggttggaatccagggttccggaaagacgacaagcgtcgcaaagctcgcccgctaccttcagaagaggggatacaaagtcggcgttgtctgttccgacacctggagaccgggagcctactaccagctcagacagcttctcgacccgtttggcatagaggtttttggtgatcccgaggagaaggacgcagttaagctcgcgagggaaggcgttgagcacttccgtgagaagggtgttgacgtcataatagtcgactccgcgggaaggcacaaggaagagaagggtctcatcgaggagatgaggcagataagcgaggccattaagccccatgaagtcatacttgtaatagatggtaccataggtcagcaggcgtacaaccaggcaatggccttcaaggaagcaacccccataggatcaataatcgtgacgaagctcgatggaagcgccaagggtggtggagcgctctcagcagtagcggcgacgggtgctccgataaagttcatcggaaccggagagaggatagacgaccttgagccctttgatccaaagcgcttcgtttcgaggctgctcggtctcggcgacatacagggccttctggagaagatagaagagctccagaaggagcaggagttcagggaagaggacatggagaagttcctgcgcggaaagttcaacctcaaggacatgtacgcccagcttgaagcgatgcagaagatgggccctctgaagcagatactccaaatgataccgggacttggctattccctcccggaggacgcagttagggtaggagaagaaaagctaaagaggtacaaagtcataatggactcaatgacggaagaagagcttgaaaacccagagatcatcaactattcgaggataaagcgcatagccagaggatctggggcaacaacggcggaagtaagggagcttctcaaccagtacaatcagatgaagaagatgttcaagagcttgaataagagaaagctcgcgaagatggccaagaagttcaatttcggggggctgggaatatga

SEQ ID NO: 14208 - protein, 448 aa, Pyrococcus kodakaraensis
MALEKLGQALNSALKKLARSSTVDEATIKEIVRDIQRALLQADVNVKLVLQLTKQIQKRALEEEPPAGVSKKEHIIKIVYEELTKFLGTEAKPLEIKHKPTVILTVGIQGSGKTTSVAKLARYLQKRGYKVGVVCSDTWRPGAYYQLRQLLDPFGIEVFGDPEEKDAVKLAREGVEHFREKGVDVIIVDSAGRHKEEKGLIEEMRQISEAIKPHEVILVIDGTIGQQAYNQAMAFKEATPIGSIIVTKLDGSAKGGGALSAVAATGAPIKFIGTGERIDDLEPFDPKRFVSRLLGLGDIQGLLEKIEELQKEQEFREEDMEKFLRGKFNLKDMYAQLEAMQKMGPLKQILQMIPGLGYSLPEDAVRVGEEKLKRYKVIMDSMTEEELENPEIINYSRIKRIARGSGATTAEVRELLNQYNQMKKMFKSLNKRKLAKMAKKFNFGGLGI

SEQ ID NO: 14209 - DNA, 1569 bp, Schizosaccharomyces pombe
  CDS (1)..(1569)
atggtttttgcagatttagggcgtcgtttgaactctgcgttaggggacttttctaaggccacttcagtgaatgaagagcttgtcgatactctgctgaaaaatatatgtacggcacttttggaaacagatgttaatgtgcgattggttcaagaattacgttcaaatattaagaaaaaaatcaatgtatcaactttgcctcagggtataaatgggaagcgaatcgtccagaaggctgtctttgatgaactttgcagtttggttgaccctaaagttgatgcttttactcctaaaaaagggagaccttcagtgatcatgatggtaggtttacaaggcagtggtaaaacgacaacatgctcaaagcttgctctgcactaccaaaggagaggtttgaaatcgtgtttggttgctgccgatactttccgtgctggtgcttttgatcaattaaagcagaatgctatcaaagcacgtgttccttactttggtagttacaccgagactgacccagtcgttattgccaaggaaggtgttgataagttcaaaaacgatagatttgacgttatcatcgttgatacatctggtaggcatcagcaggagcaggagttgtttgctgagatggtggaaatttcagacgctattcgcccagatcaaacaattatgattttagatgctagcattggtcaagctgccgaatctcaaagcaaagcgtttaaagagactgctgactttggcgctgtaataatcacaaaattggacggacatgccaaaggtggtggtgctttatccgccgtggctgcgactaagacacccatcgtgttcattggtaccggtgaacatattaatgatttggagcgcttttctccacgttcttttatctcaaagctactcggactcggtgatcttgaaggtctgatggaacacgttcagtctttagattttgataaaaagaatatggttaaaaatcttgagcaaggaaagtttacggtccgagactttcgagatcaactcggaaatattatgaaattgggaccacttagtaaaatggctagtatgattccaggcatgagtaatatgatgaacggtatgaatgatgaggagggatctttgcgtatgaagcgtatgctctacatcgttgattcaatgaccgaacaagagttagattcggatggtcttctatttgttgaacaaccctctcgtgttttacgtgttgcaaggggtagtggtacaagcgttttagaggtagaagaaaccatttctcaggtccgagtatttgcgcaaatggcgaaaaagataggaggaaaagatggaattttgggtaaacttggtggaaatccagccgcagctctcaaaaaagaccctcgtcaacttgcagctatgcagaaaagaatgcaagccatgggtatggggggaggaatgcctggcctcaatccaggttctatgaactttggtgatatttcaaaaatggctaacatgttgatgggaggcggaggtcccggaggggcaggtggtatggatttcagcggtatgctcaatcaatttcaaaatatgcaaaagcctcctcgaagacgttag

SEQ ID NO: 14210 - protein, 522 aa, Schizosaccharomyces pombe
MVFADLGRRLNSALGDFSKATSVNEELVDTLLKNICTALLETDVNVRLVQELRSNIKKKINVSTLPQGINGKRIVQKAVFDELCSLVDPKVDAFTPKKGRPSVIMMVGLQGSGKTTTCSKLALHYQRRGLKSCLVAADTFRAGAFDQLKQNAIKARVPYFGSYTETDPVVIAKEGVDKFKNDRFDVIIVDTSGRHQQEQELFAEMVEISDAIRPDQTIMILDASIGQAAESQSKAFKETADFGAVIITKLDGHAKGGGALSAVAATKTPIVFIGTGEHINDLERFSPRSFISKLLGLGDLEGLMEHVQSLDFDKKNMVKNLEQGKFTVRDFRDQLGNIMKLGPLSKMASMIPGMSNMMNGMNDEEGSLRMKRMLYIVDSMTEQELDSDGLLFVEQPSRVLRVARGSGTSVLEVEETISQVRVFAQMAKKIGGKDGILGKLGGNPAAALKKDPRQLAAMQKRMQAMGMGGGMPGLNPGSMNFGDISKMANMLMGGGGPGGAGGMDFSGMLNQFQNMQKPPRRR

SEQ ID NO: 14211 - DNA, 1344 bp, Sulfolobus solfataricus
  CDS (1)..(1344): transl_table=11
atgttagaaaatataagagatgcagtaaggaagtttcttacaggatctacaccctacgagaaagcagtagatgagtttataaaagatcttcagaagtctcttatttcatccgatgtgaatgtaaagctggttttttccttaacagcaaagattaaagaaaggctaaataaggaaaaacccccatctgtgctagaaaggaaagaatggttcatttctatagtttatgatgagctttctaaattatttggtggagataaggagcctaatgttaatcccaccaagctaccttttataataatgctagttggtgttcagggaagcggtaaaacgaccactgccggaaaattagcgtatttctacaaaaaaagaggttataaggtaggtttagttgcagccgacgtttataggcctgcagcttacgatcaattgttacagctaggtaatcaaattggtgtacaagtatatggagaaccaaataatcagaaccctattgagatagctaaaaaaggagttgatatatttgtaaagaacaaaatggatataatcatagttgatactgcaggaaggcatggatatggagaggagactaagcttctagaggaaatgaaagaaatgtatgatgtattaaagcctgatgatgtaatcttggtcatagatgcgtccattggacaaaaagcttatgatttagcatctagattccatcaagcaagtccaattggctctgtaataataacaaagatggatggtacagcaaagggaggtggggcattatcagcagtagttgctactggagctacgataaagtttataggtactggagaaaaaatagacgaactagaaacatttaatgctaagagatttgtttctagaatattaggaatgggagatatagaatcaatcttggagaaagttaagggattagaagagtatgacaaaattcaaaagaaaatggaagacgttatggaaggtaaagggaagctaacacttagagacgtttatgcgcaaatcatagccttgaggaaaatgggtcccctttctaaagtactgcaacatattcctggtttaggaattatgcttcctactcctagtgaagatcaattgaaaataggagaggaaaaaattaggagatggttagcagccttaaattctatgacatataaggaactggaaaatcctaatataattgataagtcgagaatgagaagaatagctgaaggatcagggttagaggttgaagaagtaagagaacttttagagtggtataataacatgaataggcttttgaaaatggtaaaaagaaggaggggcaatattgataaactcttcggagggaaaatcggataa

SEQ ID NO: 14212 - protein, 447 aa, Sulfolobus solfataricus
MLENIRDAVRKFLTGSTPYEKAVDEFIKDLQKSLISSDVNVKLVFSLTAKIKERLNKEKPPSVLERKEWFISIVYDELSKLFGGDKEPNVNPTKLPFIIMLVGVQGSGKTTTAGKLAYFYKKRGYKVGLVAADVYRPAAYDQLLQLGNQIGVQVYGEPNNQNPIEIAKKGVDIFVKNKMDIIIVDTAGRHGYGEETKLLEEMKEMYDVLKPDDVILVIDASIGQKAYDLASRFHQASPIGSVIITKMDGTAKGGGALSAVVATGATIKFIGTGEKIDELETFNAKRFVSRILGMGDIESILEKVKGLEEYDKIQKKMEDVMEGKGKLTLRDVYAQIIALRKMGPLSKVLQHIPGLGIMLPTPSEDQLKIGEEKIRRWLAALNSMTYKELENPNIIDKSRMRRIAEGSGLEVEEVRELLEWYNNMNRLLKMVKRRRGNIDKLFGGKIG

SEQ ID NO: 14213 - DNA, 1611 bp, Yarrowia lipolytica
  CDS (1)..(1611)
atggttcttgaagacctcggaaaacgaatcaacggcgcgtttgccaacctgtcgaagggcggcgatattgacgaggcgctggatgcgatgctcaaggaggtatgttcggctcttctagagtccgatgtgaacatcaagctggtttcacagcttcgacaaaaggtcaagaacagtgttaaggcgacgcccaacggtgcctccaagaagaaggtgatccaaaaggcgttgtttgacgagctggtcaatctggttggggtggacgagagcgctgcttctgccgccaagttcaagccgcagaagggcaagtccaatgtggtcatgtttgtgggtctgcagggatccggaaagaccacgtcatgtaccaagctggctgtctactaccagcggcgaggcttcaaggtgggattggtgtgtgccgataccttccgagctggagcgtttgaccagctcaaacagaacgccaccaaggccaagatccccttctttggctcgtacacagaaacagaccccgtggcggtggcagccgagggagtagccaagttcaagaaggagaagtttgaaatcatcatcgtcgacacctccggacgacatcgacaggaaagcgaactgtttacggaaatggtggatattggcgctgctgtgaaaccggactcgacaatcatggtgctcgacgcctccattggccaggccgccgagccccagtcacgtgccttcaaggacgcctccgactttggttccatcatcctcaccaagatggacggacacgccaagggtggaggagctatttctgcggtggcagccacaaacacccccatcattttcattggtaccggagagcacattcacgatctcgaggcgttttcgcccaagcagttcatttccaagctgctcggtatcggcgacctccaaggtctcatggagacgatgcagagtctgaatctcgaccagaagaaaaccatggagcacattcaggagggtattttcacactggcggatctcagagaccagatgggcaacatgctcaagatgggatcgttgtcctccattgctggcatgattccgggactctcgggcatggcgtcttccatttccgacgaagagggtacccgtcgaatcaagcgaatgatctacattctcgactctatgaaccagaaggagctggattcggatggatccattttcaaggaggtgccttctcgtatcacacgagttgcccggggctcgggaacctccatccgggaagtcgaggaggtgcttcagcagcagaagatgatggcctccatggcgtcgcgaatgggcggcaagaacggcatgatgtcacgaatgcagaacgcccagaacaaccctgcccagatggctgcagctcaaagacgggcccagcagatgatgggcggaggagccggaggaatgcccggcatgggaggaatgcctggaatgggcggtatgcccggaatgggtggaatgcccggtatgggaggtggtatgcctgacatgagtgctctgcagggcatgttccctggaggaatgcctgacatgggccagatgatgaacatggtacagaacaatcctcagatgaaggccatggcgagaagtatgggtctcggcatctaa

SEQ ID NO: 14214 - protein, 536 aa, Yarrowia lipolytica
MVLEDLGKRINGAFANLSKGGDIDEALDAMLKEVCSALLESDVNIKLVSQLRQKVKNSVKATPNGASKKKVIQKALFDELVNLVGVDESAASAAKFKPQKGKSNVVMFVGLQGSGKTTSCTKLAVYYQRRGFKVGLVCADTFRAGAFDQLKQNATKAKIPFFGSYTETDPVAVAAEGVAKFKKEKFEIIIVDTSGRHRQESELFTEMVDIGAAVKPDSTIMVLDASIGQAAEPQSRAFKDASDFGSIILTKMDGHAKGGGAISAVAATNTPIIFIGTGEHIHDLEAFSPKQFISKLLGIGDLQGLMETMQSLNLDQKKTMEHIQEGIFTLADLRDQMGNMLKMGSLSSIAGMIPGLSGMASSISDEEGTRRIKRMIYILDSMNQKELDSDGSIFKEVPSRITRVARGSGTSIREVEEVLQQQKMMASMASRMGGKNGMMSRMQNAQNNPAQMAAAQRRAQQMMGGGAGGMPGMGGMPGMGGMPGMGGMPGMGGGMPDMSALQGMFPGGMPDMGQMMNMVQNNPQMKAMARSMGLGI

SEQ ID NO: 14215 - DNA, 1443 bp, Oryza sativa
  CDS (1)..(1443)
atgttcgggcagctcaccaccggcctggagtccgcctggaacaagctgcgtggcgtcgatgtactaacaaaggagaatatcgttgagccaatgcgggatataagaagagcacttctggaagctgatgttagtttgcctgtagtgagaagatttgtttcgtctataagtgaaaaggctctgggttctgatcttataagaggagtccgaccggaacagcaattggtgaagattgtgcatgatgaacttgtaaaactgatgggtggagaagtatcagatctggtatttgcaaaaagtggccccacagtaatcttactggcaggcctgcaaggtgttgggaagactactgtttgcgcaaagcttgcattttacctgaagaaattgggaaagagttgtatgctggtcgctgcagatgtttacaggcctgcagccattgatcaactcactatacttggtgaacaggtcggtgtaccagtttactcagaaggaacagaagccaaacctgcacaaataaccaagaatgccgtggaagaggccaaaagaaagaatattgatgccattgtaatggatactgctggaagactgcagattgacaaatcaatgatggttgaattgaaagaagtgaagaaggcagttaatcctacggaagttctgcttgttgttgatgctatgactggacaggaagctgcagcattggtcaccaccttcaatattgagattggtatcactggtgctatattgactaaactggatggtgattcgaggggtggagcagcactaagtgttaaagaggtgtctggaaagcccatcaagtttgtagggcgtggagaacgaatggaggaccttgagcttttttatcctgaccgtatggcacaacgtgttttgggaatgggcgatgtactttcatttgttgaaaaagcacaagaagtcatgcgtcaagaagatgctgtagaattacagaagaagatcatgagtgcaaaattcgacttcaatgacttcctaaagcaatcacagaatgttgcaaaaatgggttccatgagccgtgtagttggaatgattccaggcatgaacaaggttactcctgcacaaattcgagaagccgagaaaagacttgcatttgtggagtctatgatcaatgcaatgactgccgaggaaagggaaaagccagaattactggctgaatcacgtgacaggaggataagagtggctgaagagtccggaaagagtgaacaagaggtgagccagttggttgcccagcttttccaaatgcgtgctcagatgcagaagctgatgggtgtgatgaccggacaagaagcacttccaggcatggggaatctcatggaatctcttaacgccgatgagaaggcacctcctggcactgcacggcggaagaggaggcacagcaagacgaggcagagggagctggatgcagtccctagttcttga

SEQ ID NO: 14216 - protein, 480 aa, Oryza sativa
MFGQLTTGLESAWNKLRGVDVLTKENIVEPMRDIRRALLEADVSLPVVRRFVSSISEKALGSDLIRGVRPEQQLVKIVHDELVKLMGGEVSDLVFAKSGPTVILLAGLQGVGKTTVCAKLAFYLKKLGKSCMLVAADVYRPAAIDQLTILGEQVGVPVYSEGTEAKPAQITKNAVEEAKRKNIDAIVMDTAGRLQIDKSMMVELKEVKKAVNPTEVLLVVDAMTGQEAAALVTTFNIEIGITGAILTKLDGDSRGGAALSVKEVSGKPIKFVGRGERMEDLELFYPDRMAQRVLGMGDVLSFVEKAQEVMRQEDAVELQKKIMSAKFDFNDFLKQSQNVAKMGSMSRVVGMIPGMNKVTPAQIREAEKRLAFVESMINAMTAEEREKPELLAESRDRRIRVAEESGKSEQEVSQLVAQLFQMRAQMQKLMGVMTGQEALPGMGNLMESLNADEKAPPGTARRKRRHSKTRQRELDAVPSS

SEQ ID NO: 14217 - DNA, 1638 bp, Zea mays
  CDS (1)..(1638)
atggaggccaccgcgctcgcgtcccactcgtccccgttcgccgtccaccgctcgacagggaagccagccttcgcctacccccaccgtggagggccctcgatggtctcctctgtccacctccgcacgtcccggacccccgcccgctctgcggcatggagaaggcggaggagggggaccgggctggttgtgcgcgcggagatgttcggccagctcaccaccggcctcgagtccgcctggaacaagctgcgcggcgttggcgtgctaacaaaggaaaatattgccgaaccaatgcgggacattagacgagcacttctggaagcagatgttagtttgcctgttgtgagacggtttgtttcatctgttagtgataaggctttaggtgcaaatgctatcagaggagtccgaccagaccagcaattagtgaagattgtgcatgacgaactggtacaactgatgggtggagaggtatcggatattgtatttgcaaaaagtggcccgacagttatcttgcttgcaggtctacagggtgttgggaagactactgtctgtgcaaagcttgcgttctatttgaagaaactggggaagagttgtatgctggttgctgcagacatttacaggcctgcagccattgatcaactcactatactgggtaaacaggtgggtgtaccagtttactcagaaggaacagaagccaaacctacacaaataactaagaatgctatggaagaggcaaaaagcaagaatattgatgctattgtggtggatactgctggaaggctgcagattgatagatcaatgatggatgaattgaaagaagtgaagaaggctgttaatcctacagaagttctgcttgtcgttgatgccatgactggccaagaagcagcagcactagtcaccaccttcaatattgagattggtataactggtgcaatactgactaaattggatggtgactccaggggcggagccgcactaagcgttaaagaggtctctgggaggcccataaaatttgttgggcgtggggagcgattagaggaccttgagcttttctaccctgatcgcatggcacagcgagttctgggaatgggagacgtgctttcatttgtcgaaaagacacaagaagtgatgaggcaagaagaagctatagaattacagaagaagatcatgagtgcaaaattcgacttcaacgatttcttaaaacaatctcaaaacgttgcgaaaatgggttccatgagccgcattattggaatgatgccaggcatgaacaagataactcccgcacaaatccgagaagctgagaaaagacttgcattcgtggagtcaatgatcaatgccatgactgctgaggaaagggagaagccagagttactggctgaatcacgtgagaggaggataagagtggctgaggagtctggaaagactgaacaagaggtgagtcaattggttgcccagcttttccaaatgcgtgctcagatgcagaagttgatgggtatggtgcaaggacaagaagcaatagctggcatgggagatctcatggactcgcttaaatctgaagagaaggcacctcctggcaccgcgcggcggaagagaaggaataacacgtctaagcagagggacctggacgcagtgctgagctag

SEQ ID NO: 14218 - protein, 545 aa, Zea mays
MEATALASHSSPFAVHRSTGKPAFAYPHRGGPSMVSSVHLRTSRTPARSAAWRRRRRGTGLVVRAEMFGQLTTGLESAWNKLRGVGVLTKENIAEPMRDIRRALLEADVSLPVVRRFVSSVSDKALGANAIRGVRPDQQLVKIVHDELVQLMGGEVSDIVFAKSGPTVILLAGLQGVGKTTVCAKLAFYLKKLGKSCMLVAADIYRPAAIDQLTILGKQVGVPVYSEGTEAKPTQITKNAMEEAKSKNIDAIVVDTAGRLQIDRSMMDELKEVKKAVNPTEVLLVVDAMTGQEAAALVTTFNIEIGITGAILTKLDGDSRGGAALSVKEVSGRPIKFVGRGERLEDLELFYPDRMAQRVLGMGDVLSFVEKTQEVMRQEEAIELQKKIMSAKFDFNDFLKQSQNVAKMGSMSRIIGMMPGMNKITPAQIREAEKRLAFVESMINAMTAEEREKPELLAESRERRIRVAEESGKTEQEVSQLVAQLFQMRAQMQKLMGMVQGQEAIAGMGDLMDSLKSEEKAPPGTARRKRRNNTSKQRDLDAVLS

SEQ ID NO: 14219 - DNA, 1931 bp, Brassica napus
  CDS (278)..(1768)
gggtcgacgattcgtgttgatcgtctccgactattgaacttcgtttcagttttctgtaatttcacctcctctgctaatcattcgtaacgtttgtctcccagttctaatactcttcaatattcattattactgcatcaatccaaagacgggatgagattgtaccaggaagtaagggagctgagtcaaatcgctgacgaaagatctccgaatcaaaaccctaattcctcaatcccgatcctttctctctcgatcttagtcgaatcccccagcagcgaagatggttttagcggagctcggcgggcagatcgccagcgccttgcagaagatgagcaatgtgacgatcatcgacgagaaggctctcaacgagtgcttgaaagagatcactcgtgctcttctccattcggatgtctctttccctctcgtgagggagatgcagaacaacatcaagaagatcgtcaacctcgaggagctagccgcaggccacaacaagcgacggatcatcgagcaggctatctttactgaactgtgtaagatgttggatccaggaaagcctgcgttttcacccaaaaaggctaaacctagtgctgttatgttcgttgggttacaaggtgctggtaaaaccacaacttgtaccaagtatgcttattatcatcagaagaaaggctacaaacctgctctggtgtgtgcggatactttcagggctggtgctttcgatcagctgaaacagaatgccaccaaggctaggatccccttttatggaagctacacggaatcctatcctgtgaaaattgctgtggagggagttgatacgtttaagaaagaaaactgtgatcttattattgttgacaccagtggacgccataaacaagaagctactctctttgaagaaatgcgtcaagttgctgaagcaacgaaaccagatcttgttatatttgtcatggacagcagtattggtcaagctgcatttgaccaagctcaagcatttaagcaaagtgttgccgtgggagctgtgattatcaccaagatggatggccatgctaagggtggtggtgctcttagcgctgttgcagctacaaagagtcctgtgatattcatcggaacaggagagcatatggatgagtttgaagtgtttgacgtcaaaccatttgtcagccgtctcttaggaatgggtgattggtctggattcgtggataaactacaagatgtggtacctaaagatcaacaacctgaacttctggaaaagctctctcagggtaacttcacattgagaataatgtacgaccagttccaaaacatactgaacatgggcccactgaacgaggttttctcaatgctacctggagctgctgctcaaatgatgccgaaaggacacgagaaagaaagccaagccaagataaagcgatacatgacaatgatggattctatgacaaacgaagaactggacagctcgaacccgaaggtgtttaacgagtcaaggatgatgagaatagcgagagggtcagggaggatggtaagagaagtgatggagatgttggaagagtacaagaggctagcaaagatatggagcaagatgaaaggactcaagatcccaaagaatggagacatgagcgcactctcgagaaacatgaacgctcagcacatgagcaaggtcctccctcctcagatgctcaagcagatcggaggcatgggaggtctacaaagtctcatgaaacagatgggttccggcaaagacatgatgggaatgtttggcggcggcaaagacaaatagtttctttctttctttcttacacatccaaagctacgtcttgctggtttgtcgttattagttttttcttatttgtgacaatatcaacttttgatttccctcttttgactttcctgtatttacattctcccttcagttttactttctttgtattgttcctttctct

SEQ ID NO: 14220 - protein, 496 aa, Brassica napus
MVLAELGGQIASALQKMSNVTIIDEKALNECLKEITRALLHSDVSFPLVREMQNNIKKIVNLEELAAGHNKRRIIEQAIFTELCKMLDPGKPAFSPKKAKPSAVMFVGLQGAGKTTTCTKYAYYHQKKGYKPALVCADTFRAGAFDQLKQNATKARIPFYGSYTESYPVKIAVEGVDTFKKENCDLIIVDTSGRHKQEATLFEEMRQVAEATKPDLVIFVMDSSIGQAAFDQAQAFKQSVAVGAVIITKMDGHAKGGGALSAVAATKSPVIFIGTGEHMDEFEVFDVKPFVSRLLGMGDWSGFVDKLQDVVPKDQQPELLEKLSQGNFTLRIMYDQFQNILNMGPLNEVFSMLPGAAAQMMPKGHEKESQAKIKRYMTMMDSMTNEELDSSNPKVFNESRMMRIARGSGRMVREVMEMLEEYKRLAKIWSKMKGLKIPKNGDMSALSRNMNAQHMSKVLPPQMLKQIGGMGGLQSLMKQMGSGKDMMGMFGGGKDK

SEQ ID NO: 14221 - DNA, 1803 bp, Brassica napus
  CDS (52)..(1743)
tttgcggataaaattaagagcttcttcgatcacttcacttcactactgcttatggagtctcttcaattttcgagccgtttctcggtgaatagagttcagtgtactcagaaccggacgacgagtcgaacaagtagggctgtgtgtcgttctgcgttcactggaaccaccaattcagcttctctctcttctaagagtacctccacgagggagatatggagttgggtgaaatcgaagacaattggccatggaagatacaggaggagccaagtgagggcggagatgtttggtcaattgagtagtggactcgaggctgcttggaccaaactcaaaggagaagatgtcatgacgaaggagaatattgctgagccaatgaaggatatcagaagagctctccttgaagcagatgtgagcctccctgttgttagacggtttgttcaatctgtaagtgaccaagccgttgggatgggtgtcattcgaggagtcaaaccagatcagcagttggtcaagattgtacatgatgagctagtgaagttgatgggcggagaagtatctgagctccagtttgctaagtcaggtcctacagtaatactgcttgctggtctccaaggagttgggaagacaactgttgccgctaaactcgcttataacttaaagaagcagggaaaaacttgcatgcttattgctggagatgtgtacagacctgctgccatcgatcaacttgtcattttaggtgaaaagattagtgtgccggtttatacagcacggactgaagcaaaacctgcagatatagctaagcaaggtctaaaagaagctaaaatgaataacgtcgatgtagtcatcatggatactgcagggaggcttcaggtagataaagagatgatggatgagttaaaagatgtgaagaggtttctgaaccccacagaaacgttgctagttgttgatgccatgactggacaagaagctgcatcattggtgacggcgttcagtgttgagataggaatcacaggagccatattgacaaagctagacggtgattcaagaggtggtgctgctttgagtgtcaaggaggtatctggaaaaccgataaaactggtgggacgtgaaaagagaatggaggatcttgaaccattctatcccaatagaatggctggaagaattctaggaatgggagatgtgctctcgtttgtagagaaggcacaagaagttatgcgtcaagaagatgcggaagatctacagaagaagataatgagtgaaaagttcgacttcaacgacctcctaaagcagactcgtgctgttgccaagatagggtcgatgacacgtgttcttggaatgattcctggaatggggaaagtgagtccagcgcagatacgagaagctgagaagagtcttgtcatcatggaagcaatgattgaagccatgacacctgaggaaaaggagaagccagagttactagcagaatccccagagagaagaaaaagaatagctaaagattcaggaaaaacagaacaacaggtgagccaacttgtagcacaaatattccaaatgagagtgaagatgaagaacttgatgggagcaatggaaggaggagccaaccctgcattcaccgagctcgaggacgcaatgaaagcacaacaaaaggctccacctggaaccgcaaggaggaagaagaaaaaggcggaatcaagaaagaagtttgtggagtctgcatcaagcaagccaggtcctcgtggccttggcaactaaaactcgtgttagtctttgagagacatagcaacttaagaatcatcaacattagaaagctct

SEQ ID NO: 14222 - protein, 563 aa, Brassica napus
MESLQFSSRFSVNRVQCTQNRTTSRTSRAVCRSAFTGTTNSASLSSKSTSTREIWSWVKSKTIGHGRYRRSQVRAEMFGQLSSGLEAAWTKLKGEDVMTKENIAEPMKDIRRALLEADVSLPVVRRFVQSVSDQAVGMGVIRGVKPDQQLVKIVHDELVKLMGGEVSELQFAKSGPTVILLAGLQGVGKTTVAAKLAYNLKKQGKTCMLIAGDVYRPAAIDQLVILGEKISVPVYTARTEAKPADIAKQGLKEAKMNNVDVVIMDTAGRLQVDKEMMDELKDVKRFLNPTETLLVVDAMTGQEAASLVTAFSVEIGITGAILTKLDGDSRGGAALSVKEVSGKPIKLVGREKRMEDLEPFYPNRMAGRILGMGDVLSFVEKAQEVMRQEDAEDLQKKIMSEKFDFNDLLKQTRAVAKIGSMTRVLGMIPGMGKVSPAQIREAEKSLVIMEAMIEAMTPEEKEKPELLAESPERRKRIAKDSGKTEQQVSQLVAQIFQMRVKMKNLMGAMEGGANPAFTELEDAMKAQQKAPPGTARRKKKKAESRKKFVESASSKPGPRGLGN

SEQ ID NO: 14223 - DNA, 1796 bp, Brassica napus
  CDS (45)..(1736)
ccgggtcgacgatttcgtccaccttatagtcactcacactgcttatggagtctcttcaattttcgagccgtttctcggtgaatagagttcagtgtactcagaaccggacgaggagtcgaacaagtagggctgtgtgtcgttctgcgttcactggaaccaccaattcagcttctctctcttctaagagtatctccacgagggagatatggagttgggtgaaatcaaagacaattggtcaaggaagatacaggaggagccaagtgagggcggagatgtttggtcaattgagtagtggactcgaggctgcttggaccaaactcaaaggagaagatgtcatgacgaaggagaatattgctgagccaatgaaggatatcagaagagctctccttgaagcagatgtgagcctccctgttgttagacggtttgttcaatctgtaagtgaccaagccgttgggatgggtgtcattcgaggagtcaaaccagatcagcagttggtcaagattgtacatgatgagctagtgaagttgatgggcggagaagtatctgagctccagtttgctaagtcaggtcctactgtaatactgcttgctggtctccaaggagttgggaagacaactgttgccgctaaactcgcttataacttaaagaagcagggaaaaacttgcatgcttattgctggagatgtgtacagacctgctgccattgatcaacttgtcattttaggtgaaaagattggtgtgccggtttatacagcagggactgaagcaaaacctgcagatatagctaagcaaggtctaaaagaagctaaaatgaataacgtcgatgtagtcatcatggatactgcagggaggcttcaggtagataaagagatgatggatgagttaaaagatgtgaagaggtttctgaaccccacagaaacgttgctagttgttgatgccatgactggacaagaagctgcatcattggtgacggcgttcagtgttgagataggaatcacaggagccatattgacaaagctagacggtgattcaagaggtggtgctgctttgagtgtcaaggaggtatctggaaaaccgataaaactggtgggacgtggagagagaatggaggatcttgaacccttctatcccaatagaatggctggtcgagttcttggaatgggagatgtgctctcgtttgtggagaaggcacaagaagttatgcgtgaagaagatgcggaagatctacagaagaagataatgagtgcaaagttcgacttcaacgacttcctaaagcagactcgtgctgttgcgaagatggggtcgatgacgcgtgttcttggaatgattcctggaatggggaaagtgagtccagcgcagatacgagaagctgagaagagtcttgtcatcatggaagcaatgattgaagccatgacacctgaggaaagggagaagccagagttactagcagaatccccagagagaaggaaaagagttgctaatgattcaggaaaaacagaacaacaggtgagccaacttgtagcacaaatattccaaatgagagtgaagatgaagaacttgatgggagcaatggaaggaggatccatccctgcattgagctcgctcgaggacgcaatgaaagcacaacaaaaggctccacctggaaccgcaaggaggaagaagaaaaaggcggattcaaggaagaagtttgtggagtctgcctcaagcaatccaggtcctcgtggccttggcaactaaaactcgtgttagtctttgagagacatagcaacttaagaatcatcaacattagaaagctct

SEQ ID NO: 14224 - protein, 563 aa, Brassica napus
MESLQFSSRFSVNRVQCTQNRTRSRTSRAVCRSAFTGTTNSASLSSKSISTREIWSWVKSKTIGQGRYRRSQVRAEMFGQLSSGLEAAWTKLKGEDVMTKENIAEPMKDIRRALLEADVSLPVVRRFVQSVSDQAVGMGVIRGVKPDQQLVKIVHDELVKLMGGEVSELQFAKSGPTVILLAGLQGVGKTTVAAKLAYNLKKQGKTCMLIAGDVYRPAAIDQLVILGEKIGVPVYTAGTEAKPADIAKQGLKEAKMNNVDVVIMDTAGRLQVDKEMMDELKDVKRFLNPTETLLVVDAMTGQEAASLVTAFSVEIGITGAILTKLDGDSRGGAALSVKEVSGKPIKLVGRGERMEDLEPFYPNRMAGRVLGMGDVLSFVEKAQEVMREEDAEDLQKKIMSAKFDFNDFLKQTRAVAKMGSMTRVLGMIPGMGKVSPAQIREAEKSLVIMEAMIEAMTPEEREKPELLAESPERRKRVANDSGKTEQQVSQLVAQIFQMRVKMKNLMGAMEGGSIPALSSLEDAMKAQQKAPPGTARRKKKKADSRKKFVESASSNPGPRGLGN

SEQ ID NO: 14225 - DNA, 2215 bp, Glycine max
  CDS (110)..(1807)
aattcgacaccaggggattacctaataataagtcaatatatggggcatgccacgtggatgctgtggatagaagataggaagcaagcagggaccatgagaggcagacgacatggaagccgtaacaggctcccaccatttttccactctctccctttctttctctcacaacaaaaccttgcgctcttcttctgccaaatcaatcaagctttcctctccttcgaccaacgcttccttaacttccccaaactgtttcgcgaaagaggtatggggttgggtgaactccaactccaaaggcgtcgccgtgagaaggtacacacgcggagtggtggtgagggctgaaatgttcggccagttaacaagtggccttgagactgcatggaacaaactcaaaggagaagaggttttgtctaaggagaacattgtggaacctatgcgagatatcaggagagctctcttagaagctgatgttagtcttcctgttgtcagaaggtttgtgcagtctgtcagtgatcaggctgtgggtgttggtgtcattcgtggagtgagaccagatcagcaattggttaagattgtacatgaggaacttgtacaattgatgggtggagaggtttctgaactggtttttgccaaatctgggcccactgtcattttattggctggacttcagggagttgggaagacaactgtttgcgcaaagttggcaaattatctcaagaaacagggaaaaagttgcatgctagttgctggggatgtttacagacctgctgctattgaccagcttgctattttgggaaaacaggtggatgtgcctgtctatacagcaggtactgatgttaaaccttcagaaattgccaaacaaggtttagaagaggcaaaaaagaagaaaattgatgttgttattgttgatactgctggtaggctgcagattgacaagacaatgatggatgagttaaaagaagtgaaaaaggcattgaatccaacagaagtgttgctagttgtggatgcaatgacagggcaagaagctgcagcgttggtgactactttcaatcttgagattggaataacaggtgccatcttgacaaagcttgatggcgattcaagaggtggagcagctttgagtgtcaaagaggtatccggaaagccaattaaacttgtaggacggggggaacgcatggaggatcttgaacctttctaccctgatcggatggcaggacgcatactaggaatgggagatgttctttcttttgtagagaaggcacaacaagttatgcgtcaagaagatgctgaagaattgcaaaagaagattatgagtgcaaagtttgacttcaatgattttctaaagcaaacccgtactgttgcaaaaatgggttctgtctctcgtgtcattggaatgattcctggtatggggaaggttactcctgctcaaattcgagatgcagagaagaatttgctgaacatggaagcaatgatagaagcgatgacccctgaggagagggaaaagccagaactgttggcagaatcccctgtcaggaggaaaagggttgctcaggattcagggaaaacagagcagcaggtaagccaacttgtagctcaacttttccaaatgcgtgttcgtatgaagaacctgatgggtgtaatggaaagtggatcacttccaacacttagtaatcttgaggaagcgcttaaagcagaggaaaaggctcctcctggcactgctaggaggaggaagagatcggaatcaaggagtgtatttggggactcaacaccagcaaggccaagtcctcgtggttttgggagcaaaaattgaaaatccctaaagggtttaacacaacaatataatgggaagtctggatcaacaggtcaccggtgatcaacttgtttgatttagcgttattcagctaaaataattctttaccatcattagagcaattcatatagctccaacttgtttgattcagctttcttcggctaaaatgattatttaccattattagttcaattcatattgcaatgaatgagggttgtccaggagaaagatgtaatttaggcagagatgagtcgtatcatacatatgcgggatatgttgtaaggaatatgcgtgtcattcttgttcttgtacaactcaactttgtatcttggcgtgggagtggaatgttactcataaagaccgtccaatatttttcataaaatcttctaacttaaaaaaaaaaaaaaa

SEQ ID NO: 14226 - protein, 565 aa, Glycine max
MEAVTGSHHFSTLSLSFSHNKTLRSSSAKSIKLSSPSTNASLTSPNCFAKEVWGWVNSNSKGVAVRRYTRGVVVRAEMFGQLTSGLETAWNKLKGEEVLSKENIVEPMRDIRRALLEADVSLPVVRRFVQSVSDQAVGVGVIRGVRPDQQLVKIVHEELVQLMGGEVSELVFAKSGPTVILLAGLQGVGKTTVCAKLANYLKKQGKSCMLVAGDVYRPAAIDQLAILGKQVDVPVYTAGTDVKPSEIAKQGLEEAKKKKIDVVIVDTAGRLQIDKTMMDELKEVKKALNPTEVLLVVDAMTGQEAAALVTTFNLEIGITGAILTKLDGDSRGGAALSVKEVSGKPIKLVGRGERMEDLEPFYPDRMAGRILGMGDVLSFVEKAQQVMRQEDAEELQKKIMSAKFDFNDFLKQTRTVAKMGSVSRVIGMIPGMGKVTPAQIRDAEKNLLNMEAMIEAMTPEEREKPELLAESPVRRKRVAQDSGKTEQQVSQLVAQLFQMRVRMKNLMGVMESGSLPTLSNLEEALKAEEKAPPGTARRRKRSESRSVFGDSTPARPSPRGFGSKN

SEQ ID NO: 14227 - DNA, 2073 bp, Glycine max
  CDS (128)..(1627)
  misc_feature (1)..(1): n is a, g, c or t
nagacgacagaaggggaccggcggtggaagagagatagaccaataatctgaatctgaaacctccgtgttggtgttgcatatccaaaccctaatttggaaattgaattgttgaagggaagaagacaagatggttctggcggagttaggtgggagcatttcgcgtgctctccagctgatgagcaatgcgacagtaatcgacgagaaggtgctcaacgattgcctcaacgacatcactcgcgctcttcttcaatccgatgttcaattcaagcttgtccgcgacatgcagaccaacatcaagaacattgtcaacctcgacgatctcgctgccggtcacaacaaacgcaggatcatccaacaagctgtgtttaacgaactctgcaaaattctggaccctgggaagccctctttcactcccaaaaagggcaaaacaagtgttgtcatgtttgttggtttgcaaggttctggaaaaaccacaacgtgtacaaaatacgcatattatcatcagaagaaaggctggaagccggctctagtatgtgcagatacattcagagctggtgcatttgatcaattgaagcaaaatgcaactaaagcgaagatccctttctatggaagctatatggaatcagatcctgtaaaaattgctgtggaaggggtggaacgattcaagcaagaaaactgtgatcttataattgttgacactagtgggcggcacaaacaagaagctgctctttttgaagaaatgcgccaagtttcagaagcaacgaaaccagatcttgtcatatttgttatggatagcagtatcggtcaggctgcttttgatcaagctcaagcatttaaacagagtgttgcagttggagctgtcattgtcactaaaatggatggccacgcaaaaggtggtggggctcttagtgctgtagcagcaacaaagagtcctgtcatattcattggaactggagaacacatggacgaatttgaagtttttgacgttaaaccatttgtcagtcgtctactaggcatgggagactggtctgggttcatggataaaattcatgaagttgttcctatggatcaacaacctgaactgcttcaaaagctgtcagaaggaaacttcaccttgaggattatgtatgagcagtttcagaacatacttaaaatgggtcccatcagccaggtcttttctatgctaccaggatttagtgctgaattaatgccaaaaggccgtgagaaagaaagccaggcaaaaattaagcgttacatgacaatgatggattcaatgacaaacgaagagttggatagttcaaaccccaagctcatgaatgagtcacgaatgatgcggatagctcgaggtgcaggtcgtcaaattagggaagtgatggagatgttggaagagtacaaacgtcttgcaaagatatggagcaaaatgaaagggcttaaaataccaaaaaaaggtgatatgagtgccctatcccgaaatatgaatgcccaacacatgagcaaagtcctccctcctcagatgctgaagcaaatcggtggcatgggcgggttacaaaacttgatgaagcagatgggatctgccaaagacatgatgggaatgggaggaatgtttggtggtggtggtggtgattagttgattggcttatgagctgaggattattccagaccacagtcactgtcattattgtgttttactactagattcgactgagcaggttatgcagttcaattggcgttagagtgccatctgaaatagccgcaatgggtgcaagtgtctctttttgtaaaattaaattctttttccctttttgtgtatatttacttatttagtattcagagaaatcaagtgatcaagtaatcttattcgaaattttcatagtctagtaacattagaaacaaaagctatattcctcggatcatgcttgtctcgttttggattcagctccagctagaatgtttcatttaattctagcagacagcttaagcactgttactgctaggagctagtgtccaaaaaaaaaaaaaaaaaaaaaaaaaaaaaaaaaaaaaaaaaaaaaaaaaaaaaaaaaaagaaaaaaa

SEQ ID NO: 14228 - protein, 499 aa, Glycine max
MVLAELGGSISRALQLMSNATVIDEKVLNDCLNDITRALLQSDVQFKLVRDMQTNIKNIVNLDDLAAGHNKRRIIQQAVFNELCKILDPGKPSFTPKKGKTSVVMFVGLQGSGKTTTCTKYAYYHQKKGWKPALVCADTFRAGAFDQLKQNATKAKIPFYGSYMESDPVKIAVEGVERFKQENCDLIIVDTSGRHKQEAALFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQVFSMLPGFSAELMPKGREKESQAKIKRYMTMMDSMTNEELDSSNPKLMNESRMMRIARGAGRQIREVMEMLEEYKRLAKIWSKMKGLKIPKKGDMSALSRNMNAQHMSKVLPPQMLKQIGGMGGLQNLMKQMGSAKDMMGMGGMFGGGGGD

SEQ ID NO: 14229 - DNA, 1829 bp, Glycine max
  CDS (36)..(1523)
tccaaaccctaatttggaaattgaatttttgcaagatggttctggcggagttaggtgggagcatttcgcgtgctctccagcagatgagcaacgcgacggtgatcgacgagaaggtgctcaacgattgcctcaacgtcatcactcgcgctcttcttcaatccgatgttcagttcaagctcgtccgcgacctgcagaccaacatcaagaacattgtcaacctcgacgatctcgctgcaggccacaacaaacgcaggatcatccaacaagccgtgtttaacgaactctgcaaaattctggaccctgggaagccctctttcactcccaaaaagggcaaaacaagtgttgtcatgtttgttggtttgcaaggttctggaaaaaccacaacgtgtacaaaatatgcatattatcatcagaagaaaggctggaagccggctctagtatgtgcagatacattcagagctggtgcatttgatcaattgaagcaaaatgcaactaaagctaagatccctttctatggaagttatatggaatccgatccagtaaaaattgccgtggaaggtgtggagagattcaagaaagaaaactgtgatcttataattgttgatactagtgggaggcacaaacaagaagctgctctttttgaagaaatgcgccaagtttcggaagcaacgaaaccagatcttgttatatttgttatggatagcagtattggtcaggctgcttttgatcaagcccaagcatttaagcagagtgttgcagttggagctgtaattgttaccaaaatggatggccatgcaaaaggtggtggtgctcttagtgctgttgcagcaacaaagagtcctgtcatattcattggaactggagaacatatggatgaatttgaagtttttgatgttaaaccatttgtcagtcgtctactaggcatgggagactggtctgggttcatggataaaattcatgaagttgttcctatggatcaacaacctgaactgcttcaaaagctgtcagaaggaaacttcaccttgaggattatgtatgagcagtttcagaacatacttaaaatgggtcccatcagccaggtcttttctatgctaccaggatttagtgctgaattaatgccaaaaggccgtgagaaggaaagccaggcaaaaattaaacgttacatgacaatgatggactcgatgacaaacgaagagttggatagttcaaacccaaagctcatgaatgagtcccgaatgatgcgaatagctcgaggttctggtcgtccagttagggaagtaatggaaatgttagaagagtacaaacgtcttgcaaagatttggagcaaaatgaaagggcttaaaataccaaagaagggtgaaatgagcgccttatcccgaaatatgaatgctcaacacatgagcaaagtcctccctccacagatgctaaagcaaatcggaggcatgggtgggttacaaagcttgatgaagcagatgggatctgctaaagatatgatgggaatgtttggcggtggtgataattagattgactgtggcatatgagctgaggattgtttttgatcgccactacaaactctaatacttcaaatcacaagaactcattggtgtgcaatgttcgcattgaattcagatgtattgttttatcaatcaatctgcagcagcagtctcaatggttggaatagttcatttcaattttaccttaacaacctttcttcagtaaaactaagcccccttgttttcctttttcttgtatatttttagtctttaggtgaagtcaaagcaattttattgcgaattggaagttcttgtaggagtaacattataaatatg

SEQ ID NO: 14230 - protein, 495 aa, Glycine max
MVLAELGGSISRALQQMSNATVIDEKVLNDCLNVITRALLQSDVQFKLVRDLQTNIKNIVNLDDLAAGHNKRRIIQQAVFNELCKILDPGKPSFTPKKGKTSVVMFVGLQGSGKTTTCTKYAYYHQKKGWKPALVCADTFRAGAFDQLKQNATKAKIPFYGSYMESDPVKIAVEGVERFKKENCDLIIVDTSGRHKQEAALFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQVFSMLPGFSAELMPKGREKESQAKIKRYMTMMDSMTNEELDSSNPKLMNESRMMRIARGSGRPVREVMEMLEEYKRLAKIWSKMKGLKIPKKGEMSALSRNMNAQHMSKVLPPQMLKQIGGMGGLQSLMKQMGSAKDMMGMFGGGDN

SEQ ID NO: 14231 - DNA, 1890 bp, Glycine max
  CDS (97)..(1584)
agatagaccaataatctgaatctgaaacctccgtgttggtgttgcatatccaaaccctaatttggaaattgaattgttgaagggaagaagatcaagatggttctggcggagttaggtgggagcatttcgcgtgctctccagctgatgagcaatgcgacagtaatcgacgagaaggtgctcaacgattgcctcaacgacatcactcgcgctcttcttcaatccgatgttcaattcaagcttgtccgcgacatgcagaccaacatcaagaacattgtcaacctcgacgatctcgctgccggtcacaacaaacgcaggatcatccaacaagctgtgtttaacgaactctgcaaaattctggaccctgggaagccctctttcactcccaaaaagggcaaaacaagtgttgtcatgtttgttggtttgcaaggttctggaaaaaccacaacgtgtacaaaatatgcatattatcatcagaagaaaggctggaagccggctctagtatgtgcagatacattcagagctggtgcttttgatcaattgaagcaaaatgcaactaaagctaagatccctttctatggaagctatatggaatccgatcctgtaaaaattgctgtggaaggtgtggagagattcaagaaagaaaactgtgatcttataattgttgatactagtgggaggcacaaacaagaagctgctctttttgaagaaatgcgccaagtttcggaagcaacgaaaccagatcttgttatatttgttatggatagcagtatcggtcaggctgcttttgatcaggctcaagcatttaagcagagtgttgcagttggagctgtcattgtcaccaaaatggatggccatgcaaagggtggtggtgctcttagtgctgttgcagcaacaaagagtcctgtcatattcattggaactggagaacatatggatgaatttgaagtttttgatgttaagccatttgtcagtcgtctattaggcatgggagactggtctgggttcatggataaaattcatgaagttgttcctatggatcaacaacctgaactgcttcaaaagctgtcagaaggaaacttcaccttgaggattatgtatgagcagtttcagaacatacttaaaatgggtcccatcagccaggtcttttctatgctaccaggatttagtgctgaattaatgccaaaaggccgtgagaaggaaagccaggcaaaaattaaacgttacatgacaatgatggattcgatgacaaacgaagagttggatagttcaaacccaaagctcatgaatgagtcccgtatgatgcgaatagctcgaggttctggtcgtccagttagggaagtaatggaaatgttagaagagtacaaacgtcttgcaaagatttggagcaaaatgaaagggcttaaaataccaaagaagggtgaaatgagcgccttatcccgaaatatgaatgctcagcacatgagcaaagtcctccctccacagatgctaaagcaaatcggaggcatgggtgggttacaaagcttgatgaagcagatgggatctgctaaagatatgatgggaatgtttggtggtggtgataattagattgactgtggcatatgagctgaggattgtttttgatcgccactacaaactctaatacttcaaatcacaagaactcattggtgtgcaatgttcgcattgaattcagatgtattgttttatcaatcaatctgcagcagcagtctcaatggttggaatagttcatttcaattttaccttaacaacctttcttcagtaaaactaagcccccttgttttcctttttcttgtatatttttagtctttaggtgaagtcaaagcaattttattgcgaattggaagttcttgtaggagtaacattataaatatg

SEQ ID NO: 14232 - protein, 495 aa, Glycine max
MVLAELGGSISRALQLMSNATVIDEKVLNDCLNDITRALLQSDVQFKLVRDMQTNIKNIVNLDDLAAGHNKRRIIQQAVFNELCKILDPGKPSFTPKKGKTSVVMFVGLQGSGKTTTCTKYAYYHQKKGWKPALVCADTFRAGAFDQLKQNATKAKIPFYGSYMESDPVKIAVEGVERFKKENCDLIIVDTSGRHKQEAALFEEMRQVSEATKPDLVIFVMDSSIGQAAFDQAQAFKQSVAVGAVIVTKMDGHAKGGGALSAVAATKSPVIFIGTGEHMDEFEVFDVKPFVSRLLGMGDWSGFMDKIHEVVPMDQQPELLQKLSEGNFTLRIMYEQFQNILKMGPISQVFSMLPGFSAELMPKGREKESQAKIKRYMTMMDSMTNEELDSSNPKLMNESRMMRIARGSGRPVREVMEMLEEYKRLAKIWSKMKGLKIPKKGEMSALSRNMNAQHMSKVLPPQMLKQIGGMGGLQSLMKQMGSAKDMMGMFGGGDN

SEQ ID NO: 14233 - DNA, 1885 bp, Zea mays
  CDS (184)..(1668)
ttctttctcagttctcacctcaacgtcaccgcaactccgcaagtccgcaacctcctccttcccaccccttctcacgcgattcaagcgtttcccattcggagccctaatcctctctttccatactcgcggaagccaccaccaccggcaggggaagcggaaggggagcacctcgggccaggcaagatggtgcttgcgcagctgggcgggagcatctcccgcgccctggcgcagatgagcaacgccacggtgatcgatgagaaggtgctcaacgactgcctcaacgagatctcgcgcgctctcctacaggccgatgtccagttcaagatggtccgcgacatgcaggccaacatcaagcgcatcgtcaacctcgaggcgcttgccgcaggcaccaacaagcgccgtatcatgcagcaggctgtcttcacggaactctgcaacatgttagatcccgggaagccttctttcactcccaaaaagggcaagccaagcgtagtcatgtttgttggtctgcaaggttcgggtaaaactaccacttgttcaaaatatgcttattatcatcagaagaaaggattcaaaccagcgctggtttgtgccgatacatttagagctggtgcttttgatcagttaaagcaaaatgcaacgaaggccaagattcccttttacggaagttacatggaatctgatccagtgaaaattgctgttgagggtgtggagaggttcaagaaagaaaactgtgatctcatcattgtggatacaagtggaaggcacaaacaagaagcagcactctttgaagaaatgcggcaagtttcggaagcaacaaaaccagacttggtgatttttgtgatggacagtagtataggtcaggctgcatttgatcaagcacaggcatttaaacaaagtgtttctgttggtgctgtgattattacaaaaatggatggtcacgcaaaaggtggcggcgcccttagcgcggtcgcagcaacaaaaagtcctgttatattcattggaactggagagcacattgatgattttgaagtttttgatgtgaagccatttgttagtcgcctgttaggtatgggagattggtcaggctttatggacaagattcatgaagtgatacctacagatcaacagcctgaccttctgcagaaactgtctgaaggaagctttagtctcaggcttatgtatgagcagttccagaaccttcttaaaatgggtcctattggccaggtcttctctatgttgccagggtttagcgctgaactaatgccaaaaggacatgagaaggaaagccaggctaagattaagcgctacatgacaatgatggattccatgactgatgcagagcttgacagcacaaatcctaagttgatgactgaatcacggatcattcggattgcacgggggtctgggcggcctgtcagggatgtcatggacatgctggaagagtacaagcgacttgctaaaatctggggcaagatgaagggtctcaagctccaaaagaaaggggacatgagtgcactgacccgcaacatgaatgttcagcagatgagcaaggcccttcctccgcagatgcttaaacagattggtggcatgggcggtctgcagtctctgatgaaacagatgggatcgaaggagatgagcggaatgtttggaggcatgggtggttgacttgtttttggtggatcgtcgctgtgatgctaaattgagagcgtttaatgctgcggtctgatcaccatcagagcattccctgaagatcagcctgcgctatgttttggatcaggcttagcgtagctccccatgcctgcaaatttaacctatatgaacagtacgtttgtcctctgaaaaaacggataaggtatatattacaaagcgaatatgcttatgt

SEQ ID NO: 14234 - protein, 494 aa, Zea mays
MVLAQLGGSISRALAQMSNATVIDEKVLNDCLNEISRALLQADVQFKMVRDMQANIKRIVNLEALAAGTNKRRIMQQAVFTELCNMLDPGKPSFTPKKGKPSVVMFVGLQGSGKTTTCSKYAYYHQKKGFKPALVCADTFRAGAFDQLKQNATKAKIPFYGSYMESDPVKIAVEGVERFKKENCDLIIVDTSGRHKQEAALFEEMRQVSEATKPDLVIFVMDSSIGQAAFDQAQAFKQSVSVGAVIITKMDGHAKGGGALSAVAATKSPVIFIGTGEHIDDFEVFDVKPFVSRLLGMGDWSGFMDKIHEVIPTDQQPDLLQKLSEGSFSLRLMYEQFQNLLKMGPIGQVFSMLPGFSAELMPKGHEKESQAKIKRYMTMMDSMTDAELDSTNPKLMTESRIIRIARGSGRPVRDVMDMLEEYKRLAKIWGKMKGLKLQKKGDMSALTRNMNVQQMSKALPPQMLKQIGGMGGLQSLMKQMGSKEMSGMFGGMGG

SEQ ID NO: 14235 - DNA, 24 bp, Artificial sequence
  primer
atggttttggctgatttggggaag

SEQ ID NO: 14236 - DNA, 24 bp, Artificial sequence
  primer
ttagcccataccgaattgttttgc

SEQ ID NO: 14237 - protein, 471 aa, Artificial sequence
  consensus sequence
  Variant (2)..(6): Xaa in position 2 to 6 is any amino acid
  Variant (7)..(7): Xaa in position 7 is any or no amino acid
  Variant (9)..(22): Xaa in position 9 to 22 is any amino acid
  Variant (23)..(36): Xaa in position 23 to 36 is any or no amino acid
  Variant (38)..(39): Xaa in position 38 to 39 is any amino acid
  Variant (43)..(44): Xaa in position 43 to 44 is any amino acid
  Variant (47)..(50): Xaa in position 47 to 50 is any amino acid
  Variant (52)..(57): Xaa in position 52 to 57 is any amino acid
  Variant (59)..(78): Xaa in position 59 to 78 is any amino acid
  Variant (79)..(84): Xaa in position 79 to 84 is any or no amino acid
  Variant (86)..(87): Xaa in position 86 to 87 is any amino acid
  Variant (90)..(109): Xaa in position 90 to 109 is any amino acid
  Variant (110)..(133): Xaa in position 110 to 133 is any or no amino acid
  Variant (138)..(138): Xaa in position 138 is any amino acid
  Variant (139)..(140): Xaa in position 139 to 140 is any or no amino acid
  Variant (145)..(147): Xaa in position 145 to 147 is any amino acid
  Variant (149)..(149): Xaa in position 149 is any amino acid
  Variant (151)..(156): Xaa in position 151 to 156 is any amino acid
  Variant (158)..(162): Xaa in position 158 to 162 is any amino acid
  Variant (163)..(163): Xaa in position 163 is any or no amino acid
  Variant (165)..(166): Xaa in position 165 to 166 is any amino acid
  Variant (169)..(169): Xaa in position 169 is any amino acid
  Variant (171)..(171): Xaa in position 171 is any amino acid
  Variant (174)..(175): Xaa in position 174 to 175 is any amino acid
  Variant (178)..(188): Xaa in position 178 to 188 is any amino acid
  Variant (191)..(194): Xaa in position 191 to 194 is any amino acid
  Variant (195)..(209): Xaa in position 195 to 209 is any or no amino acid
  Variant (212)..(214): Xaa in position 212 to 214 is any amino acid
  Variant (216)..(217): Xaa in position 216 to 217 is any amino acid
  Variant (219)..(225): Xaa in position 219 to 225 is any amino acid
  Variant (226)..(227): Xaa in position 226 to 227 is any or no amino acid
  Variant (229)..(230): Xaa in position 229 to 230 is any amino acid
  Variant (235)..(235): Xaa in position 235 is any amino acid
  Variant (239)..(243): Xaa in position 239 to 243 is any amino acid
  Variant (244)..(245): Xaa in position 244 to 245 is any or no amino acid
  Variant (247)..(248): Xaa in position 247 to 248 is any amino acid
  Variant (251)..(258): Xaa in position 251 to 258 is any amino acid
  Variant (260)..(264): Xaa in position 260 to 264 is any amino acid
  Variant (266)..(266): Xaa in position 266 is any amino acid
  Variant (268)..(269): Xaa in position 268 to 269 is any amino acid
  Variant (273)..(273): Xaa in position 273 is any amino acid
  Variant (275)..(276): Xaa in position 275 to 276 is any amino acid
  Variant (278)..(279): Xaa in position 278 to 279 is any amino acid
  Variant (282)..(290): Xaa in position 282 to 290 is any amino acid
  Variant (291)..(291): Xaa in position 291 is any or no amino acid
  Variant (293)..(293): Xaa in position 293 is any amino acid
  Variant (296)..(296): Xaa in position 296 is any amino acid
  Variant (299)..(299): Xaa in position 299 is any amino acid
  Variant (301)..(301): Xaa in position 301 is any amino acid
  Variant (306)..(306): Xaa in position 306 is any amino acid
  Variant (310)..(311): Xaa in position 310 to 311 is any amino acid
  Variant (313)..(314): Xaa in position 313 to 314 is any amino acid
  Variant (316)..(317): Xaa in position 316 to 317 is any amino acid
  Variant (319)..(319): Xaa in position 319 is any amino acid
  Variant (321)..(321): Xaa in position 321 is any amino acid
  Variant (324)..(328): Xaa in position 324 to 328 is any amino acid
  Variant (330)..(330): Xaa in position 330 is any amino acid
  Variant (332)..(335): Xaa in position 332 to 335 is any amino acid
  Variant (337)..(337): Xaa in position 337 is any amino acid
  Variant (339)..(340): Xaa in position 339 to 340 is any amino acid
  Variant (343)..(343): Xaa in position 343 is any amino acid
  Variant (346)..(369): Xaa in position 346 to 369 is any amino acid
  Variant (370)..(374): Xaa in position 370 to 374 is any or no amino acid
  Variant (376)..(376): Xaa in position 376 is any amino acid
  Variant (377)..(378): Xaa in position 377 to 378 is any or no amino acid
  Variant (382)..(386): Xaa in position 382 to 386 is any amino acid
  Variant (388)..(392): Xaa in position 388 to 392 is any amino acid
  Variant (397)..(401): Xaa in position 397 to 401 is any amino acid
  Variant (402)..(402): Xaa in position 402 is any or no amino acid
  Variant (404)..(404): Xaa in position 404 is any amino acid
  Variant (407)..(426): Xaa in position 407 to 426 is any amino acid
  Variant (427)..(436): Xaa in position 427 to 436 is any or no amino acid
  Variant (440)..(441): Xaa in position 440 to 441 is any amino acid
  Variant (443)..(451): Xaa in position 443 to 451 is any amino acid
  Variant (452)..(454): Xaa in position 452 to 454 is any or no amino acid
  Variant (457)..(458): Xaa in position 457 to 458 is any amino acid
  Variant (460)..(460): Xaa in position 460 is any amino acid
  Variant (462)..(462): Xaa in position 462 is any amino acid
  Variant (466)..(470): Xaa in position 466 to 470 is any amino acid
LXXXXXXAXXXXXXXXXXXXXXXXXXXXXXXXXXXXIXXALLXXDVXXXXVXXXXXXIXXXXXXXXXXXXXXXXXXXXXXXXXXVXXELXXXXXXXXXXXXXXXXXXXXXXXXXXXXXXXXXXXXXXXXXXXXGLQGXXXGKTTXXXKXAXXXXXXGXXXXXXVXXDTXRXGAXXQLXXXXXXXXXXXYGXXXXXXXXXXXXXXXXXXXDPXXXAXXGXXXXXXXXXDXXIVDTXGRHXXXXXXXLXXEMXXXXXXXXPXXXXXVXDXXIGQXAXXQXXAFXXXXXXXXXXIXTKXDGXAXGGGAXSAVXXTXXPXXFXGXGEXXXXXEXFXXXXFXSXXLGXGDXXXXXXXXXXXXXXXXXXXXXXXXXXXXXGXXXFTLXXXXXQXXXXXKMGPXXXXXXMXPGXXXXXXXXXXXXXXXXXXXXXXXXXXXXXXSMTXXEXXXXXXXXXXXXSRXXRXAXGSGXXXXXV

SEQ ID NO: 14238 - protein, 29 aa, Artificial sequence
  protein pattern
  Variant (2)..(2): Xaa in position 2 is any amino acid
  Variant (3)..(3): Xaa in position 3 is any or no amino acid
  Variant (5)..(8): Xaa in position 5 to 8 is any or no amino acid
  Variant (10)..(11): Xaa in position 10 to 11 is any amino acid
  Variant (13)..(13): Xaa in position 13 is Ala or Pro
  Variant (14)..(14): Xaa in position 14 is Ala or Gly
  Variant (16)..(16): Xaa in position 16 is any amino acid
  Variant (17)..(17): Xaa in position 17 is Asp, Glu, Asn or Gln
  Variant (19)..(19): Xaa in position 19 is Ala or Leu
  Variant (20)..(22): Xaa in position 20 to 22 is any amino acid
  Variant (23)..(23): Xaa in position 23 is Ala, Cys, Gly or Ser
  Variant (24)..(27): Xaa in position 24 to 27 is any amino acid
  Variant (28)..(28): Xaa in position 28 is Ile or Val
  Variant (29)..(29): Xaa in position 29 is Asp, Pro, Gln, Ser or Thr
LXXAXXXXDXXRXXAXXQXXXXXXXXXXX

SEQ ID NO: 14239 - protein, 60 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(7): Xaa in position 7 is any amino acid
  Variant (8)..(8): Xaa in position 8 is any or no amino acid
  Variant (11)..(11): Xaa in position 11 is any amino acid
  Variant (14)..(14): Xaa in position 14 is any amino acid
  Variant (15)..(15): Xaa in position 15 is Ala, Ser or Thr
  Variant (16)..(16): Xaa in position 16 is any amino acid
  Variant (17)..(17): Xaa in position 17 is Ala or Gly
  Variant (19)..(19): Xaa in position 19 is Ala or Gly
  Variant (20)..(20): Xaa in position 20 is Ala or Thr
  Variant (21)..(21): Xaa in position 21 is Ile or Leu
  Variant (22)..(22): Xaa in position 22 is Ser or Thr
  Variant (23)..(30): Xaa in position 23 to 30 is any amino acid
  Variant (31)..(31): Xaa in position 31 is Ile or Val
  Variant (32)..(33): Xaa in position 32 to 33 is any amino acid
  Variant (34)..(34): Xaa in position 34 is Ile, Leu or Val
  Variant (36)..(36): Xaa in position 36 is any amino acid
  Variant (37)..(37): Xaa in position 37 is Glu or Gly
  Variant (38)..(38): Xaa in position 38 is Glu or Lys
  Variant (39)..(41): Xaa in position 39 to 41 is any amino acid
  Variant (42)..(42): Xaa in position 42 is Asp or Glu
  Variant (43)..(43): Xaa in position 43 is Phe, Ile or Leu
  Variant (44)..(44): Xaa in position 44 is Asp or Glu
  Variant (45)..(45): Xaa in position 45 is any amino acid
  Variant (47)..(47): Xaa in position 47 is any amino acid
  Variant (48)..(48): Xaa in position 48 is Ala, Pro or Val
  Variant (49)..(50): Xaa in position 49 to 50 is any amino acid
  Variant (51)..(51): Xaa in position 51 is Phe or Met
  Variant (52)..(52): Xaa in position 52 is Ala, Ile or Val
  Variant (53)..(53): Xaa in position 53 is Ala, Gly, Gln or Ser
  Variant (54)..(54): Xaa in position 54 is Lys or Arg
  Variant (55)..(55): Xaa in position 55 is Ile, Leu, Met or Val
  Variant (58)..(58): Xaa in position 58 is any amino acid
GXXXXIXXTKXDGXXXXGXXXXXXXXXXXXXXXXGXXXXXXXXXXFXXXXXXXXXLGXGD

SEQ ID NO: 14240 - protein, 28 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(8): Xaa in position 7 to 8 is any amino acid
  Variant (9)..(9): Xaa in position 9 is Ile, Leu, Met or Val
  Variant (10)..(14): Xaa in position 10 to 14 is any amino acid
  Variant (16)..(19): Xaa in position 16 to 19 is any amino acid
  Variant (20)..(20): Xaa in position 20 is Phe, Leu or Met
  Variant (21)..(21): Xaa in position 21 is Ile or Val
  Variant (22)..(22): Xaa in position 22 is Ile, Leu or Met
  Variant (24)..(24): Xaa in position 24 is Ala, Gly or Ser
  Variant (25)..(25): Xaa in position 25 is Ala, Gly, Ser or Thr
  Variant (26)..(26): Xaa in position 26 is Ile or Leu
LXXEXMXXXXXXXXPXXXXXXXDXXXGQ

SEQ ID NO: 14241 - protein, 16 aa, Artificial sequence
  protein pattern
  Variant (3)..(3): Xaa in position 3 is Ala, Ser or Val
  Variant (8)..(8): Xaa in position 8 is Ser, Thr or Val
  Variant (9)..(9): Xaa in position 9 is Ala, Cys, Thr or Val
  Variant (10)..(10): Xaa in position 10 is Ala, Gly, Ser or Thr
  Variant (12)..(12): Xaa in position 12 is any amino acid
  Variant (14)..(15): Xaa in position 14 to 15 is any or no amino acid
QGXGKTTXXXKXAXXY

SEQ ID NO: 14242 - protein, 15 aa, Artificial sequence
  protein pattern
  Variant (2)..(3): Xaa in position 2 to 3 is any amino acid
  Variant (4)..(4): Xaa in position 4 is Ala or Ser
  Variant (7)..(7): Xaa in position 7 is Glu, Gln or Ser
  Variant (8)..(8): Xaa in position 8 is Ala, Asn, Ser or Thr
  Variant (11)..(11): Xaa in position 11 is Ala, Asp, Asn, Gln or Ser
  Variant (12)..(12): Xaa in position 12 is Phe, Ile, Leu or Val
  Variant (13)..(13): Xaa in position 13 is any amino acid
  Variant (14)..(14): Xaa in position 14 is Leu, Met or Val
IXXXLLXXDVXXXXV

SEQ ID NO: 14243 - protein, 17 aa, Artificial sequence
  protein pattern
  Variant (2)..(2): Xaa in position 2 is Ile or Val
  Variant (3)..(3): Xaa in position 3 is Ala or Ser
  Variant (4)..(4): Xaa in position 4 is any amino acid
  Variant (5)..(5): Xaa in position 5 is Asp, Glu or Gly
  Variant (8)..(12): Xaa in position 8 to 12 is any amino acid
  Variant (14)..(15): Xaa in position 14 to 15 is any amino acid
  Variant (16)..(16): Xaa in position 16 is any or no amino acid
RXXXXSGXXXXXVXXXL

SEQ ID NO: 14244 - protein, 8 aa, Artificial sequence
  protein pattern
  Variant (2)..(2): Xaa in position 2 is Phe, Ile or Val
  Variant (5)..(5): Xaa in position 5 is Ala or Ser
IXDTXGRH

SEQ ID NO: 14245 - protein, 21 aa, Artificial sequence
  protein pattern
  Variant (2)..(3): Xaa in position 2 to 3 is any amino acid
  Variant (4)..(4): Xaa in position 4 is Ser or Thr
  Variant (5)..(5): Xaa in position 5 is Ile, Leu or Val
  Variant (6)..(7): Xaa in position 6 to 7 is any amino acid
  Variant (8)..(8): Xaa in position 8 is Phe, Ile, Leu, Met or Val
  Variant (9)..(11): Xaa in position 9 to 11 is any amino acid
  Variant (12)..(12): Xaa in position 12 is Phe, Ile, Leu or Met
  Variant (13)..(14): Xaa in position 13 to 14 is any amino acid
  Variant (15)..(15): Xaa in position 15 is Phe, Ile, Leu, Met or Val
  Variant (16)..(17): Xaa in position 16 to 17 is any amino acid
  Variant (20)..(20): Xaa in position 20 is Pro or Ser
  Variant (21)..(21): Xaa in position 21 is Ile, Leu, Met or Val
GXXXXXXXXXXXXXXXXMGXX

SEQ ID NO: 14246 - DNA, 1290 bp, Saccharomyces cerevisiae
  CDS (1)..(1290)
atggtagacgtggaagagaaaagtcaagaagttgaatatgttgatccaacggtgaatagggtgcccaattatgaggtatctgaaaaggcgtttcttttgacacaatcaaaggttagtattgaacagcgtaaggaagcggcagagttcgttttagccaaaattaaagaggaagaaatggccccttattataaatatctttgcgaggaataccttgttaataatggccaatctgacttggaacacgatgaaaagtcagattctttaaacgaatggatcaaatttgaccaggagctatacaatgaattgtgcaaaaaaaatgaaagtaagattaaagagttaaatgaaaagatccaaaaattggaagaagatgatgaaggtgaactagaacaagctcaagcctggattaatctgggtgaatattatgcacaaatcggtgacaaagataatgctgaaaagacgctagggaaatcattatcgaaggctatttccacaggcgccaaaattgatgttatgctaacaattgcaaggctggggttcttttataacgaccaactttatgttaaggagaagttggaagcagtcaattctatgattgaaaaaggtggtgactgggagagaagaaatagatataaaacatactatggtatccactgcttggccgtaagaaactttaaggaagcggcaaagttattggtcgattctctagcaactttcacctctattgaattaacttcctatgaaagcattgccacatatgcatcggtcacaggtttattcactctggaaagaacagacctaaaatccaaagtcatcgattcacctgaattgttatctttaatctcaacaactgccgcactacaatctatctcgtcgttaacaatttccctttacgcgtccgattatgccagttactttccatatcttttggaaacatatgcaaatgttttgattccatgtaaatatttgaatagacatgcagatttctttgttagagaaatgagaagaaaagtctacgcacaattgttggaatcatataagactttgtcgctgaaatctatggcaagcgcatttggtgtttcggttgcgttcttggataacgacctgggtaagtttattccaaataagcaactaaattgtgtcattgatagagttaatgggatcgtagagaccaacaggccagacaacaaaaatgctcaataccatctgctagttaagcaaggtgacggtttgctaacaaaattacaaaaatacggtgcagcagtgagattgacagggtcagatcgtgtttga

SEQ ID NO: 14247 - protein, 429 aa, Saccharomyces cerevisiae
MVDVEEKSQEVEYVDPTVNRVPNYEVSEKAFLLTQSKVSIEQRKEAAEFVLAKIKEEEMAPYYKYLCEEYLVNNGQSDLEHDEKSDSLNEWIKFDQELYNELCKKNESKIKELNEKIQKLEEDDEGELEQAQAWINLGEYYAQIGDKDNAEKTLGKSLSKAISTGAKIDVMLTIARLGFFYNDQLYVKEKLEAVNSMIEKGGDWERRNRYKTYYGIHCLAVRNFKEAAKLLVDSLATFTSIELTSYESIATYASVTGLFTLERTDLKSKVIDSPELLSLISTTAALQSISSLTISLYASDYASYFPYLLETYANVLIPCKYLNRHADFFVREMRRKVYAQLLESYKTLSLKSMASAFGVSVAFLDNDLGKFIPNKQLNCVIDRVNGIVETNRPDNKNAQYHLLVKQGDGLLTKLQKYGAAVRLTGSDRV

SEQ ID NO: 14248 - DNA, 1632 bp, Glycine max
  CDS (116)..(1276)
gcgaggcccacgcatttgtacggaggaaggaagacgaaggaagcgggaatttggaggaaggaaggtaaaggaagcaaacgcaagagcaagagcaagagcgaaagcggcagagaagatggaaggagaagagggttctcagcagccacagttggtgctcgcggacaagctattccttctccggcaacccgatgtgcaagacattgacaaggttcgctacaaagaggatgtcttcactcatgtcaaggaaaacgatatggtccctctgtacgaaaccctagtcgctgattccgtgttggacttggatcgtgcccttttggactctatgcgcgctaaaattgacgacgagctcaccaagctcgacgaaaagattgctgatgccgaggaaaacttaggagagagtgaagttcgtgaggctcatttggcaaaatccttgtttttcatccggattatggacaaggagaaagccttggaacatctgaaggtaacagaaaccaagacagttgcagttggccagaaaatggacttggtgttttatacattgcagcttggtttctttgacatggattttgatctcatttccaaaagcatagacaaagccaaaaacttgtttgaggaaggtggtgattgggaaaggaagaataggctgaaagtgtatgaaggcctgtactgcatgtccactcgaaatttcaagaaggctgccaagttatttttggattctatttcaaccttcaccacctatgaactttttccctatgacacctttatattttatactgttttgaccagcattatatcattggatagagtttccctaaagcaaaaggtagtagatgctccagagatcttgacagtgattggcaaaatcccatatctttcagagtttttgaactccttatatgattgccaatacaagtcttttttctcagcatttgctggcctgacggagcaaattaagttggaccgctatctgcatccacacttccgttattacatgagggaggtcagaacagttgtttattcccaatttttggaatcttacaagagtgtgacaattgaagccatggcaaaagcctttggagtgacagtagatttcattgatgtggagctatcacgttttattgcagcagggaagcttcattgtaagattgataaagttgcaggtgttcttgaaactaatcgccctgatgctaagaatgctctttaccaagcaactattaagcaaggggacttcctgctgaatcggatccagaaattgtcacgtgtgatagatctttaggtcatctcttgcattttagattaaaatttactggaaaggcagagataatgacaatttcaaatttgaaggacatccttttgaatacatttctgtagtccatttgatttccaaatatgaacggttgaacttgctgcatccaaatatgtcaatcagttttcaattatttctgtgaaaaaagaaataaattgttaatctgattgcgtataaaaaatgactggctgatgcaaacacatgtttgatcattgtgcttgccttcgacgagatttcccttctatcccttcacccgatttcttccgagtcctgctaggttgaaacggaggacttggtaccctatataatcagtgagtgttacccat

SEQ ID NO: 14249 - protein, 386 aa, Glycine max
MEGEEGSQQPQLVLADKLFLLRQPDVQDIDKVRYKEDVFTHVKENDMVPLYETLVADSVLDLDRALLDSMRAKIDDELTKLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFKKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTVDFIDVELSRFIAAGKLHCKIDKVAGVLETNRPDAKNALYQATIKQGDFLLNRIQKLSRVIDL

SEQ ID NO: 14250 - DNA, 2059 bp, Zea mays
  CDS (220)..(1389)
  misc_feature (1963)..(1963): n is a, g, c or t
  misc_feature (1984)..(1984): n is a, g, c or t
aaaaaaaaaaaaaaaaaaaaaaaaaaaaaaaatcttcttcttgcagccgaagcaaagtgagggcgtaccgaaaggagtctagcaaacaaaccgcagcctgagcacccgaggagacaccgtgggaaagaaaccgcagcctgagcacccgaggagactccgtgcgaccgaagccagagccagcggaaccgaacggaagcgagacccccggcggctagcgagatggacggcggcgccggcgaggaggggaagcaggagcggcacctggtgctggcccacaagctcttccttctatcccacccctccgttgatgacctctccaaggtcgccctccgcgccgaagtcctcgacaccgtgaaatccgatgatatggcgacgctgtttgagtcgctggtcgccgcgggtgtgctggagggggacgccgcgctgctggccgagatgcgtgggaggattgacgaggagatccgcaagcttgatgagaaaattgctgatgcggaggagaacttgggtgagagcgaagtccgtgaagcacatcttgccaaatctttgtactttataagggtcggtgagaaggaaaaggccctggaacagcttaaagtcactgaaggaaaaactgtagctgttggccaaaagatggatcttgtgttccacactttgcagattggttttttctacatggattttgatctgatatcaaaatccatcgataaggcaaagaacttgtttgaggaaggaggcgattgggagaggaagaacaggttgaaagtatatgaaggcttgtactgcatggcaaccagaaacttcaagaaagctgccagcttatttttagactcgatttcgactttcacaacttatgagatattcccatatgatacgttcatcttctatacagtcctcacaagtgtcatcacattggatcgtgtatctctgaaacaaaaggtggtagatgcaccagaaatcctggctgtaattggcaaagtacctcacctctccgagtttctcaactccctgtacaactgccagtataagtcgttcttcgttgcattttctggtctgacagagcaaatcaagttagaccgttatcttcagcctcatttccgctactacatgagggaagtgcgcaccgtggtatactcacagttcttagagtcatacaagagtgtgacaatggaagcaatggccactgcgttcggtgtaactgttgatttcattgaccaggaactgtcacggttcattgcagctgggaagctgcactgcaagattgataaggttgctggtgttctggagactaaccgacctgatgagaggaatgctttctaccaggcgaccatcaagcaaggggacttcttgctgaaccgcatccagaagctttcacgggtcattgacctgtaaggactgtttgtgttggagctattcctgcaatcggcgcctgcaaatgtttcccaccctacgtcttccacaagacatctctgcttgagtggggattggggaacaagccctaagaacatctgtgttttaagtgcagaatatttgtgttttaatcagtaaacgctgtcctgtcatttcaagtttcctatctgtggctctgtctgtgattttcttccttaagttgttagcttgacaatctggtgcccttttgacctacatacataatgagctatgatacgcggcccgtaaaaagagttcagttgaaaaaaaaaaaaaaaaaaaagaaaaaagaaacccgctcacaaagcagtcctcccaccgcacgcaacgcagcctcgacctcgacctcgccgtcgccatggtgagcaagcagacccgccgcctcctcgtccttgccgccgtcgccgtatgcctccacctccccgccgcctctgtcgccaccgacgtcgattactgcagtaaaaaggagtacccggtgaaggtgagcggggtgcagatcgtgcccgatccggtcgagcccggcaagcccgccactttncagatctccgcttctactgantaaacatcgagaagggaagctggtgatcgacgtcagtactttcttctctacgtgcactcggagacgcgcgaaatc

SEQ ID NO: 14251 - protein, 389 aa, Zea mays
MDGGAGEEGKQERHLVLAHKLFLLSHPSVDDLSKVALRAEVLDTVKSDDMATLFESLVAAGVLEGDAALLAEMRGRIDEEIRKLDEKIADAEENLGESEVREAHLAKSLYFIRVGEKEKALEQLKVTEGKTVAVGQKMDLVFHTLQIGFFYMDFDLISKSIDKAKNLFEEGGDWERKNRLKVYEGLYCMATRNFKKAASLFLDSISTFTTYEIFPYDTFIFYTVLTSVITLDRVSLKQKVVDAPEILAVIGKVPHLSEFLNSLYNCQYKSFFVAFSGLTEQIKLDRYLQPHFRYYMREVRTVVYSQFLESYKSVTMEAMATAFGVTVDFIDQELSRFIAAGKLHCKIDKVAGVLETNRPDERNAFYQATIKQGDFLLNRIQKLSRVIDL

SEQ ID NO: 14252 - DNA, 1448 bp, Zea mays
  CDS (86)..(1252)
aacgagtctaaaccactgaaaaaaaggctcctgtatctcccatagtcccatcttcttgcagccgaagcaaagtgagggcggcgagatgaacggcggcggggaggacgggaagcagcagccgcacctggtactggcgcacaagctgttcctcctgtcgcactccgacgtcgacgacctcgccaaggtcgacctacgcgctgacgtgttcgcggcagtcaaatccgatgacatggcagctctgtacgagtcgttggcggcggacggcgtactggagacggacgcggcgctgctggccgagatgcgcgccaggatcgacgaggagatccggaagctcgacgagaagattgctgatgcagaggagaacttgggtgagagtgaagtgcgtgaggcccatctcgccaaatccttatatttcataagggttggggagaaggagaaagcactggagcagcttaaagttactgaaggaaaaactgtagctgttgggcaaaagatggaccttgttttctacacactacaaataggattgttctatatggactttgatctcatctcgaagtccattgacaaagcgaaaaacttgtttgaggaaggtggtgattgggaaaggaagaacagattgaaagtatatgaagggttgtactgcatggcaactagaaacttcaagaaagctgctagtttattcttggattcaatttcaactttcacgacatatgagctattcacatatgatacattcatcttctacacagtcctcacgagtgttatatctctggaccgtgtatctctgaaacaaaaggttgtagatgcacctgagatcttagccgtaattggcaaagtacctcacctctcagagtttctcaattccctctacaattgccagtacaagtcattttttattgcattctctggcttgactgaaccaatcaagttagagcgttacttgcagcctcattttcgctactacatgcgtgaagtgcgcactgttgtctactcacagtttctggaatcgtacaagagtgtgacaatggaagccatggctgctgcatttggcgttacagtcgactttatagaccaggaactgtcacgcttcattgccgctgggaagctccactgcaagatagacaaagttgctggcgtcttggaaacgaaccgacctgatgctaggaacgccttctaccaggcaaccatcaagcaaggagactttttgctgaaccgcatccagaagctgtcacgagttatcgacctgtaggggagagcccttcatgcaggagcttgccttggttcctggagtgtacgggcggtgcttgactttcaatgggtctcagttgaagaagcttttagggatatttgtgttctgagaaattgtgttctgcactttttagcctaactacatgaagccccaaaaaaaattcatggcgttgcttgtagacgtctcttcattgatg

SEQ ID NO: 14253 - protein, 388 aa, Zea mays
MNGGGEDGKQQPHLVLAHKLFLLSHSDVDDLAKVDLRADVFAAVKSDDMAALYESLAADGVLETDAALLAEMRARIDEEIRKLDEKIADAEENLGESEVREAHLAKSLYFIRVGEKEKALEQLKVTEGKTVAVGQKMDLVFYTLQIGLFYMDFDLISKSIDKAKNLFEEGGDWERKNRLKVYEGLYCMATRNFKKAASLFLDSISTFTTYELFTYDTFIFYTVLTSVISLDRVSLKQKVVDAPEILAVIGKVPHLSEFLNSLYNCQYKSFFIAFSGLTEPIKLERYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 14254 - DNA, 1369 bp, Glycine max
  CDS (51)..(1205)
aaaaaagaagagtgtatttggaggaaggaaggtaaaggaagccagaggagatggaagaagagggttctcagcagccacagttggtgcttgccgagaagctattccttctccgacaacccgttcaagacattgacaaggttcgctacaaggaggatgttttcactcacatcaaggaaaacgagatggtccctttgtacgagaccctagtcgccgattccgtgttggacttggatcgtgcccttttggacttcatgcgcgctaaaattgaagacgagctcaccaagctcgacgaaaagattgctgatgctgaggaaaacttaggagagagtgaagttcgtgaggctcacttggcaaaatccttgttttttatccggattatggacaaggagaaagccttggaacatctcaagataacagaaaccaagacagttgcagttggccagaaaatggacttggtgttttatacattgcagcttggtttcttcgacatggattttgatctcgtttccaaaagcattgacaaagccaaaaacttgtttgaagaaggtggtgattgggaaaggaagaataggctgaaagtgtacgaaggcctgtactgcatgtccactcgaaatttcaagaaggctgccaagttgtttttggattctatttcaacctttaccacctgtgaactttttccctatgacacctttatattttatacagttttgaccagcattatatcattggatagagtttccctaaagcaaaaggtagtggatgctccagagatcttgacagtgattggcaaaatcccatatctttcagagtttttgaactccttatatgattgtcaatacaagtcttttttctcagcatttgctggcctgacagagcaaattaagttggaccgctatctgcatccacacttccgatattacatgagggaggtcagaaccgttgtttattcccaatttttggaatcttacaagagtgtgacaattgaagccatggcaaaagcctttggagtgacagaggatttcattgatgtggagctatcacgctttattgcagcagggaagcttcattgtaagattgataaagttgaaggtgttcttgaaactaatcgccctgatgctaagaatgctctttaccaagcaactattaagcaaggggacttcctattgaatcggatccagaaattgtcacgtgtgatagatctttaggtcattttttgcattttagactaaaagtttattggaaaggcagagataacgacaatttcacggtattttactacgagggtgaggcacggcatttctgtagtccatttgatgtgcaaatatgattaattaaatttgccaaatccaaatatatcaatcagttttcg

SEQ ID NO: 14255 - protein, 384 aa, Glycine max
MEEEGSQQPQLVLAEKLFLLRQPVQDIDKVRYKEDVFTHIKENEMVPLYETLVADSVLDLDRALLDFMRAKIEDELTKLDEKIADAEENLGESEVREAHLAKSLFFIRIMDKEKALEHLKITETKTVAVGQKMDLVFYTLQLGFFDMDFDLVSKSIDKAKNLFEEGGDWERKNRLKVYEGLYCMSTRNFKKAAKLFLDSISTFTTCELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTEDFIDVELSRFIAAGKLHCKIDKVEGVLETNRPDAKNALYQATIKQGDFLLNRIQKLSRVIDL

SEQ ID NO: 14256 - DNA, 1393 bp, Glycine max
  CDS (66)..(1226)
aaatataaactaggaatagctattttgttggaaggaggtaaaggaagttcgtgacaaaagcggcaatggaaggagaagagggttcccagcagccacagttggtgctcggggacaagctattccttcttcgacaacccgatgttcaagacattgacaaggttcgctacaaggaggatgttttcactcacatcaaccaaaacgatatggtccccttgtatgaaaccctagtggccgattccgtgttggacttggatcgtgccctcttggactctatgcgcgctaaaattcacgatgagctcgccaacctcgacgaaaagattgctgatgctgaggaaaacttaggagagagtgaagttcgtgaggctcacttggcaaaatccttgtttttcatccggattatggacaaggagaaagccttggaacatctcaaggtaacagaaaccaagacagttgctgttggccagaaaatggacttggtgttttatacattgcagcttggtttctttgacatggattttgatctcatttccaagagcattgacaaagccaaaaacttgtttgaagaaggtggtgattgggaaaggaagaataggctgaaagtgtacgaaggactgtactgcatgtccactcgaaatttcgagaaggctgccaagttgtttttggattccatttcaacctttaccacctatgaactttttccctatgacacctttatattttatacagttttgaccagcattatatcattggatagagtttccctaaagcaaaaggtagtggatgctccagagatcttgacagtgattggcaaaatcccttatctttcagagtttttgaactccttatatgattgtcaatacaagtcttttttctcagcatttgctggcctgacggagcaaattaagttggaccgctatctgcatccacacttccgatattacatgagggaggtcagaaccgttgtttattcccaatttttggaatcttacaagagtgtgacaattgaagccatggcaaaagcctttggagtgacagaggatttcattgatgtggagctatcacgctttattgcagcagggaagcttcattgtaagattgataaagttgaaggtgttcttgaaactaatcgccctgatgctaagaatgctctttaccaagcaactattaagcaaggggacttcctattgaatcggatccagaaattgtcacgtgtgatagatctttaggtcattttttgcattttagactaaaagtttattggaaaggcagagataacgacaatttcacggtattttactacgagggtgaggcacggcatttctgtagtccatttgatgtgcaaatatgattaattaaatttgtcaaatccaaatatgtcaatcagttttcaatt

SEQ ID NO: 14257 - protein, 386 aa, Glycine max
MEGEEGSQQPQLVLGDKLFLLRQPDVQDIDKVRYKEDVFTHINQNDMVPLYETLVADSVLDLDRALLDSMRAKIHDELANLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFEKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTEDFIDVELSRFIAAGKLHCKIDKVEGVLETNRPDAKNALYQATIKQGDFLLNRIQKLSRVIDL

SEQ ID NO: 14258 - DNA, 1464 bp, Gibberella zeae PH-1
  CDS (1)..(1464)
atgggttccgacccccagtacgccaaatggccattgctgcctctttcgcagcatgtcttcaccctcacaaacggctacgccactaagaatgcgcaacaagcctctgttaaggccctccaagatgccattgcccaggacaagatggctcctttttaccgatatctcgctcaccccctcgatggcgtcctcaacaccgttggcgagggcggcgcttccgctccaggacgacctcttagcaggaagtcgagcctggttggaatgatcgccaccaagcctgctgctgccaacatcagtctcccctgggatgagggtctttacaaccagctgaaagaggacaacgatcgtgagctagaagagatccagaaagaggaggatgatgctgtggagcaagctggtgacactgaggtcatggccgcccaaggcaagcgagcagaattctgggctcgagtgggagacaaggacaaagctattgccacctacgagagcctcttcgagaagacgggcattctcggtaccaagatcgacctcgttcttgctataatacgtatgggcttgttttatggtgataagcctctcgtaaagaagcatgttgagcgcgccaagggtcttgtcgacacaggcggtgactgggaccgtcgcaaccgcctcaaggcctacgaaggcctgcacctgctcaccgttcgatcatacaatctcgctgcgccgctgctcctcgactctctctccacctttaccagctacgagctctgcacttactccaaccttgttgtgtattctgttctcgctggctcagtctccctcaagcgagtcgatttcaagtcaaaggtcgttgatgcaccagagatcaaggcaattcttggcgatggcgacgacaagctgctagctctgagcggcgctctcagtgctggaccaggtgccgatgacaccgttggcgcgaaggcacccaagacggccaccgctgctgtgaatctgaccacattgggcacaagcactgaccatcccgaagctgagatggctatcgacttcagccccttggccctgctcgtcagcagcttgtacaagggcgactacaaggccttcttcacgtccctggccaatgtcgaggagcagttcctaaaccaggatcgctaccttcacgagcacaagaactggttcatccgagagatgcgacttcgcgcttaccagcagctcctgcaaagctaccgtgttgtcggccttgagagcatggctaacgactttggtgtcactgtcgacttcctcgaccgtgacctcgcccgcttcattgctgctggccgcattccttgcaccatcgaccgcgtgacaggcaagggtgttattgagaccaaccgccccgatgacaagaacaagcaataccaagatgtcgtgcgacaaggcgatcagctcattacaaagctacaaaagtacggtcaggctgtgcggctgaggggtagcgagagagcatag

SEQ ID NO: 14259 - protein, 487 aa, Gibberella zeae PH-1
MGSDPQYAKWPLLPLSQHVFTLTNGYATKNAQQASVKALQDAIAQDKMAPFYRYLAHPLDGVLNTVGEGGASAPGRPLSRKSSLVGMIATKPAAANISLPWDEGLYNQLKEDNDRELEEIQKEEDDAVEQAGDTEVMAAQGKRAEFWARVGDKDKAIATYESLFEKTGILGTKIDLVLAIIRMGLFYGDKPLVKKHVERAKGLVDTGGDWDRRNRLKAYEGLHLLTVRSYNLAAPLLLDSLSTFTSYELCTYSNLVVYSVLAGSVSLKRVDFKSKVVDAPEIKAILGDGDDKLLALSGALSAGPGADDTVGAKAPKTATAAVNLTTLGTSTDHPEAEMAIDFSPLALLVSSLYKGDYKAFFTSLANVEEQFLNQDRYLHEHKNWFIREMRLRAYQQLLQSYRVVGLESMANDFGVTVDFLDRDLARFIAAGRIPCTIDRVTGKGVIETNRPDDKNKQYQDVVRQGDQLITKLQKYGQAVRLRGSERA

SEQ ID NO: 14260 - DNA, 1254 bp, Candida glabrata CBS 138
  CDS (1)..(1254)
atggtagatgataagaagttcaatgaagaggaggacggggaggtccagtacgttgacccaacggttaacaaggtgcctaattatgaagcatctgagttagcatttgtgcttacacaggacaagttgagtagcaagcacagcgaagtgcttgataagttgatgaagctaatagaagaggaagagatggctccttattataaatatcttgctgaagaatatgtgccacaaggggggcttctgaaatttgacaaatcactatatgatagattggtggaaaagaacgaacagaagattgctgattttaagaagaaaattgaagaaattgaggagaatgatgaaggtgaactggagagagcacaagcatggattaatttgggtgaatattacgctcagattggtgatcgtatcaacgctcaggaaacattggagaaagcattggagaaggctatctcaactggtgcaaagatcgatgttatgttgacaattacaagaattggttttttctacaatgaccagctatttgtcaaggacaggctagctcaaaccaacgctatgattgagaaaggtggtgactgggagagaagaaacagatataagacctacaagggtattcactctctagctataagggatttcaaagaggctgcaaacttgctggttgactctctagctactttcacctccatagagcttacatcatatgaaaatattgccacatatgcctctgttgccggcttatttgctctagaaagaactgatttaaaggccaaggtcgtagactcaccagatttactatcattaattaacacaacacctgcattacagtccatctcatccttgactatttcattgtatacatcagattacgcaagttacttcccctttttgcttgagacttacgacaatgttctgatcccttccaagtatttgaatgtacatgctgattattttgtaagggagatgagaagaaaagtttacgcccaacttcttgagtcttataaaactctttctctgaagtcaatggccagtgcatttggtgtatcagtggaattccttgacaatgacttgggtaaattcatcccaaacaggcaattgaactgtgtcattgacagggttaatggtatcgtggagacaaacaggccggacaataaaaacgcccaatacagcttgcttgtcaagcaaggtgacggtttactaaccaaattgcagaaatacggtgctgctgttagattaactggctccgatcgtttatag

SEQ ID NO: 14261 - protein, 417 aa, Candida glabrata CBS 138
MVDDKKFNEEEDGEVQYVDPTVNKVPNYEASELAFVLTQDKLSSKHSEVLDKLMKLIEEEEMAPYYKYLAEEYVPQGGLLKFDKSLYDRLVEKNEQKIADFKKKIEEIEENDEGELERAQAWINLGEYYAQIGDRINAQETLEKALEKAISTGAKIDVMLTITRIGFFYNDQLFVKDRLAQTNAMIEKGGDWERRNRYKTYKGIHSLAIRDFKEAANLLVDSLATFTSIELTSYENIATYASVAGLFALERTDLKAKVVDSPDLLSLINTTPALQSISSLTISLYTSDYASYFPFLLETYDNVLIPSKYLNVHADYFVREMRRKVYAQLLESYKTLSLKSMASAFGVSVEFLDNDLGKFIPNRQLNCVIDRVNGIVETNRPDNKNAQYSLLVKQGDGLLTKLQKYGAAVRLTGSDRL

SEQ ID NO: 14262 - DNA, 1227 bp, Kluyveromyces lactis NRRL Y-1140
  CDS (1)..(1227)
atgtctgaagatactgaagttcaatacgtggatcctagtgtgaatcgtgtgccaaattacgaggcatccgatcatgcttttgtccttggacaagggaatctctctcatctacatgaagcctcaagggatgctttgttgaaactgatcagagaagatcatatggctccatattataaacatgtgtgcgaagagttaccctcgggagccattgagtgggatcaatccttttacgattcgttagtggcgaagaacgaagaagagattaagaagttaaaggatcatttaactgaaattgaagagaaagacgaaggtgagttggagaaggctcaatcctggatcaatttaggtgagtattatgcaaagattggtgataaagacaacgccgaggaaacgttgaccaaggccttggataaagctgtgtctactggtgccaagatcgatatcatgttaactataaccagacttggattcttctacaacgatcagcattacgtgaagcagaagctagaaggagtcaatgcgatgattgagaaaggtggtgattgggaaagaagaaatagatacaagacttataaggggatccattcgatggccatcagagatttcaagaccgctgcgtccttactagtcgaatcgttagccactttcacttctaccgagcttacctcgtatgagaacatcgctacctacgcgttcgttactgggttatttgcatttgaaaggactgatttgaaggaaaagattatcgattcgcctgacttgctagcgttgatgacaacgacgccagcgttacaatccatatcctccctttccatttcactttacacttccgaatataaaagttatttcccatatttgttagagacctacgacaaagtgctattgccctccaaatatttgaaccaacacgccgattattttgtaagggaaatgagaagaatggtttacgctcaactattggaatcttacaagacgctctcgataaaatcgatggctggtgcattcggcgtctctgaagatttcttagacaaagatctaagcaaattcataccaacgaaacaactcaactgtgtcatcgaccgtgtcaacggtatagtagagacaaatcggccagataacaagaacgctcaataccaacttctcgtaaaacagggtgatggattgattacaaaactacaaaagtatggtgcggctgttaagcttacaggcaccgatcgtataatatag

SEQ ID NO: 14263 - protein, 408 aa, Kluyveromyces lactis NRRL Y-1140
MSEDTEVQYVDPSVNRVPNYEASDHAFVLGQGNLSHLHEASRDALLKLIREDHMAPYYKHVCEELPSGAIEWDQSFYDSLVAKNEEEIKKLKDHLTEIEEKDEGELEKAQSWINLGEYYAKIGDKDNAEETLTKALDKAVSTGAKIDIMLTITRLGFFYNDQHYVKQKLEGVNAMIEKGGDWERRNRYKTYKGIHSMAIRDFKTAASLLVESLATFTSTELTSYENIATYAFVTGLFAFERTDLKEKIIDSPDLLALMTTTPALQSISSLSISLYTSEYKSYFPYLLETYDKVLLPSKYLNQHADYFVREMRRMVYAQLLESYKTLSIKSMAGAFGVSEDFLDKDLSKFIPTKQLNCVIDRVNGIVETNRPDNKNAQYQLLVKQGDGLITKLQKYGAAVKLTGTDRII

SEQ ID NO: 14264 - DNA, 1203 bp, Debaryomyces hansenii CBS767
  CDS (1)..(1203)
atggagtattttgaatcagatgttcctaatatccctgatcataggttatcagaaaaacaatttcttttaagtacgaatatcgctgctcgccaccgagaggaaatcatgaatgaattgattgaatcgatcaaggaagagaatttagcaccatactataaatatttacaaggtgaatacagcgattttccatttgacgaatcagtgtacaaatcgatggttgaaaaaaatgaagaggagattgcacaattaaacctgaagatcaaggaagcagaaggagaggacgaaacagagctcgatgcattgacttgtaacgtcaaccttgcggaatattataccaagatatgtgatagacataatgcggtgacaactttcaaaaaggcgttggaattaccccaaggtaccgggtctaagattgacattttattgtctttggcaagaattgagttcttttacaatgactatgcgttagtgtccaagtatttggaccaagtcaagagccatatagacaagggtggtgattgggaacgtcgtaaccgttacaagacatactgtggtatcttcttgatggctaccagagatttcgccgaggcgtccaaattattgaacgactcgttggccactttcacatcgaccgaaatctgtagttacgaacaacttgcactctatgctgtggtatcgggcgccgtgtcgttagacagaggcgatttgaaatcgaaaataatcgattctccagagatcttatccatctattcatcagcaccagaattagaaccactcatcaacttaactaattccttatacacatgtcaatataactgctttttccaatatttgctcgaatcatacgatcagttgttactttcaagcaagtatttgaaccagcatgccaactatatattgcgtgaaatgagatgcaaggcatacggccaattgttggaaagttacaagtccttatccttaaagtcaatggcccgtaatttcaacatcagcgaggagttcttggatcaagatttatgcaaattcattcctaacaaaaagttgaattgtactatcgacaaggtcaacgggatcattgaaacgaacagacccgataacaaaaacaatcagtatcacttgttgatcaagcaaggtgataacttgttaaccaaattacaaaaatacggtgctgctgtcaagttaagtggtgctgagcgtgttgcgtaa

SEQ ID NO: 14265 - protein, 400 aa, Debaryomyces hansenii CBS767
MEYFESDVPNIPDHRLSEKQFLLSTNIAARHREEIMNELIESIKEENLAPYYKYLQGEYSDFPFDESVYKSMVEKNEEEIAQLNLKIKEAEGEDETELDALTCNVNLAEYYTKICDRHNAVTTFKKALELPQGTGSKIDILLSLARIEFFYNDYALVSKYLDQVKSHIDKGGDWERRNRYKTYCGIFLMATRDFAEASKLLNDSLATFTSTEICSYEQLALYAVVSGAVSLDRGDLKSKIIDSPEILSIYSSAPELEPLINLTNSLYTCQYNCFFQYLLESYDQLLLSSKYLNQHANYILREMRCKAYGQLLESYKSLSLKSMARNFNISEEFLDQDLCKFIPNKKLNCTIDKVNGIIETNRPDNKNNQYHLLIKQGDNLLTKLQKYGAAVKLSGAERVA

SEQ ID NO: 14266 - DNA, 1425 bp, Yarrowia lipolytica CLIB122
  CDS (1)..(1425)
atgacagaagagaaaaaagccatccccgactacgagctcagcaagcatctgtttgtgctgcgaaacccgtcgctcaaggaccttcatcccgaggccaaggaggccctcatgacggccatctttgatcgcaacctcgctggcgtctacaagtcgctttacaactttgaccagagccagagcacagaaacgtctggaggcgtcgtggtggatgttcccgaagaccagcagggccagattggccacgagggagagagcccctccgaggacgttgatatggaggaggtcaaggccgaggtggccgatggcaagaccgtggaggaggtggaggagaagattgtggatagcaagccgcagcccatcacacagatcatcgtgcctgccaacactccgtccgagtcgttggctcagtccgtgcctgctttctccaaagccaagtacgacaagatggtggcagccaatgacgcacgcgtggccgagctgagagaagccattgcccaggtggagaaggacgacggcggagaactggagctgctgcaggcccgagtcaagcttggagagtactacgccgagattggcgaccggttcaacgccatcctgaccctgcgaaaggccgcagagaccacctctactggtgccaagatcgacatcctattcaccattgtgcgcctgggcttcttctacctcgattgcgcctttgtgggccgagaactggaggccgttaaagtgcttatcgaacgaggaggagactgggagcgacgaaacaagtacaagacatactggggcctgcactgtctgtcaatccgaaagttcgaggaggcttcctcgtgtctcattgactctttgtctaccttcacctctgttgaaatcgcctcctacgaggagattgtggagtatgctatcattgctggagctgtggctctggatcgagtcgatctgaagcgaaagatcatcgactcacccgaggtgctgtctttgctgcccaccacccctgctcttggtcccattgccactctcaccaactcgctgtacactgctgagtactctgtgctgttcacctctctggcccagcttgagacccagtctctgcgaccatcaaagtacctggcaccccacagagccttctacgtgcgggagatgcgacgaaaggcctacgcacagcttctggagtcttacaaaacgctgtctctcaagagcatggccaatgcatttggagtgtcgtcccagtttctggacaacgacctctctaagtttatttctcagaacaagctcaactgtgtgattgaccgggtcaacggtatcattgagagcaaccgacccgactccaagaacgcccagtaccaggctctgattaagcagggagacgctctgttgaccaagctgcaaaagtacggtgctgctgttcgactgagtggtgctgagaagtaa

SEQ ID NO: 14267 - protein, 474 aa, Yarrowia lipolytica CLIB122
MTEEKKAIPDYELSKHLFVLRNPSLKDLHPEAKEALMTAIFDRNLAGVYKSLYNFDQSQSTETSGGVVVDVPEDQQGQIGHEGESPSEDVDMEEVKAEVADGKTVEEVEEKIVDSKPQPITQIIVPANTPSESLAQSVPAFSKAKYDKMVAANDARVAELREAIAQVEKDDGGELELLQARVKLGEYYAEIGDRFNAILTLRKAAETTSTGAKIDILFTIVRLGFFYLDCAFVGRELEAVKVLIERGGDWERRNKYKTYWGLHCLSIRKFEEASSCLIDSLSTFTSVEIASYEEIVEYAIIAGAVALDRVDLKRKIIDSPEVLSLLPTTPALGPIATLTNSLYTAEYSVLFTSLAQLETQSLRPSKYLAPHRAFYVREMRRKAYAQLLESYKTLSLKSMANAFGVSSQFLDNDLSKFISQNKLNCVIDRVNGIIESNRPDSKNAQYQALIKQGDALLTKLQKYGAAVRLSGAEK

SEQ ID NO: 14268 - DNA, 1455 bp, Aspergillus nidulans FGSC A4
  CDS (1)..(1455)
atggggtccgatcctcagtatatcaagttccccgacctctctctcgcccaacatgtcttcaacctttcgaatcctgcatgcccccagacgctgcggcaatcttctcagaagaagcttcaagaagcaataactgagaagaaaatggcccccttctaccgacaccttgcccaccccgtcgaaggcattctgaaccactcgagtgagggcgcctcccagccaccgtcatcaagtgctgtcaagccgctcagcactctagcatcgcggagattgtcgcagaaaatagattttccctgggatgaagctctgtatcaatcactcgttgaagacaatcggaaggagttagcggagttccagaaggaagaagacgaagcggaggaagctgccggtgacaccgaggtgcaggccgcgcgagggaaacgtgcggagttctgggcgcgggtaggagataaggacaaagcgattgagtcccacgaaacgctcctagagaagacgacgttcctgggatccaagatcgatctagtgctcgcgatgattcgaattggactcttcttcggtgacactttatacgtgaagaaaaacattgaacgggcggaaggattgattgaaagtggtggtgattgggataggagaaaccgtctaaaggcatacaagggcttacacctgctcacggtccggtcctacagcgctgccgctcctttacttcttgacagcctgtctacattcaccagctatgaactatgcagctactccgctcttgtcatctacgcagtgcttgcaggctccctgtccctgaagcgggtcgacttcaaggccaaggtggtggatgctcccgagatcaaggcgatcctcggatcgggcgaggaccgtctcgccgcgctgaccggcgagatctcctctgggcctggagctcaagatgaagagatgaaagatgcttcttcgtcaggcgctaccaccgccgtcaaccttactgcctttggcggcaacaccggcattcaggcggaggctgagaaccctatcgacttcacacctctttccaacctggttagcagcttatacaacggcaactaccggactttcttcctagctctcgctgccgtggaggaccatttcttgacccaagacagatacttgtatgagcatcgggcctggttcgtgcgtgaaatgaggctcagagcctaccagcaactcctccagagttaccgggttgtggggttgaacagcatggccaatgatttcggcgttacggttgactatttggatcgggatcttgccaggttcatttcgaacaaccgaatcgcatgcacgatcgatcgcgtcaatggaattatcgagacgaacaggccggatgacaagaacaagcagtacgcggatgtggtcaaacacggggatgcgttaatcacgaaactccagaaatacggtcaagcagtgcgcctgaggggaagcgagcgcagctag

SEQ ID NO: 14269 - protein, 484 aa, Aspergillus nidulans FGSC A4
MGSDPQYIKFPDLSLAQHVFNLSNPACPQTLRQSSQKKLQEAITEKKMAPFYRHLAHPVEGILNHSSEGASQPPSSSAVKPLSTLASRRLSQKIDFPWDEALYQSLVEDNRKELAEFQKEEDEAEEAAGDTEVQAARGKRAEFWARVGDKDKAIESHETLLEKTTFLGSKIDLVLAMIRIGLFFGDTLYVKKNIERAEGLIESGGDWDRRNRLKAYKGLHLLTVRSYSAAAPLLLDSLSTFTSYELCSYSALVIYAVLAGSLSLKRVDFKAKVVDAPEIKAILGSGEDRLAALTGEISSGPGAQDEEMKDASSSGATTAVNLTAFGGNTGIQAEAENPIDFTPLSNLVSSLYNGNYRTFFLALAAVEDHFLTQDRYLYEHRAWFVREMRLRAYQQLLQSYRVVGLNSMANDFGVTVDYLDRDLARFISNNRIACTIDRVNGIIETNRPDDKNKQYADVVKHGDALITKLQKYGQAVRLRGSERS

SEQ ID NO: 14270 - DNA, 1203 bp, Candida albicans SC5314
  CDS (1)..(1203): transl_table=12
atggaaattgaatcagatatcccaaagatccccgattttcaattatcagagaagcaatttttattgcaacacactgacttggaagagaaggaccgtcaacacattatagaggaaatcctccaagcaatcaaaaaagatcaccttgctccatattatcattatttacataccgaaatctccgacttcccttacgacgagagtttatatcgtgaattagcttctgaaaacgaaaaggtgattgaagaattgaaactgaaaatcaaggaggctgaagatgaggaagacacagagttggacgtggcatcaacaacaacaaaattagcagaatactacactaaaattatcgatagaaaaaatgctacagagacatttaagaaagtgttagaattgactccaaatactggtagcaaaattgatcatttgttgacactaacaagaatagattttttcttcaacgatttgccactggttcaaaagcatttggaacaaattggccaattaagtgagaagggaggtgattgggaacgtcgtaaccgtttcaaagcttacaatggcatttatatgttggcaacaagaaactttgctgaagcggcaaagttgttaattgattctttggctacatttacatctaccgaactctgttcttatgaagcaattgctcactgtgctatcgttgccggtgttttgtctttagaaagggttgatttgaaaaacaaaataattgattctcccgagattttgtccatcgcatccacaacacctaatttagaaccgttgttgaatttgacaaattctttatatacttgcgagtacaattgctttttccagtatcttttggaatcgtatgaaaagttgttgttgccaaataaatacttgtacaaacatgctaactttttccttagagaaatgagatgcaaagcttataaccaattgttggaaagttataaatcattatccttgaaatctatggcaactaatttcaacataagtgaagagtttttggatcaagatttgtgcaaattcatccctaacaaaaagttaaattgtacgattgataaggtgaatgggataattgaaacaaatagaccggataacaagaacaaccaatatcatgccttgattaaacaaggggataacttgttaaccaaattacaaaaatacggtgcagcagtcaagttgagtggggcagaaagagttgcttaa

SEQ ID NO: 14271 - protein, 400 aa, Candida albicans SC5314
MEIESDIPKIPDFQLSEKQFLLQHTDLEEKDRQHIIEEILQAIKKDHLAPYYHYLHTEISDFPYDESLYRELASENEKVIEELKSKIKEAEDEEDTELDVASTTTKLAEYYTKIIDRKNATETFKKVLELTPNTGSKIDHLLTLTRIDFFFNDLPSVQKHLEQIGQLSEKGGDWERRNRFKAYNGIYMLATRNFAEAAKLLIDSLATFTSTELCSYEAIAHCAIVAGVLSLERVDLKNKIIDSPEILSIASTTPNLEPLLNLTNSLYTCEYNCFFQYLLESYEKLLLPNKYLYKHANFFLREMRCKAYNQLLESYKSLSLKSMATNFNISEEFLDQDLCKFIPNKKLNCTIDKVNGIIETNRPDNKNNQYHALIKQGDNLLTKLQKYGAAVKLSGAERVA

SEQ ID NO: 14272 - DNA, 1161 bp, Capsicum annuum
  CDS (1)..(1161)
atggattctgaagaaggaacacaacaaccccagctagttctggcacacaaactattccgtttaacacatccagatgtcaatgacttagacaaagttcgtctccgtgaagaagtattggaagctgtactctccaatgatatggtaccgttgtatgaaaccctagttactaatggggttttgagtttggatcagaaggttctagattctatgcgtgctaaaaattgtgatgagctcaaaaaactcgatgacaagattgctgatgcagaagaaaacttaggtgaaagtgaagttcgggaagctcatttggcaaaatcattgttctacattcggattggtgacaaggagaaagcacttgaacaactcaaggtgaccgagagcaaaactgttgcagttgggcaaaagatggacttggcgttctacaccttgcagatgggattatttgacttggattttgacctcatctctaaaagcatcgacaaggcaaagaaattatttgaagaggggggtgactgggagagaaagaacaggttgaaggtgtatgaagggctgttctgcatgtccactcgtaacttcaagaaagcagcagatcttttcctagattctatatcaacttttaccacatatgagctttttccttatgatactttcatattttatacggtgcttacgagcatcattaccttggatcgggtttccttgaaacagaaggtagtggatgcaccagagatcttgacagtaattggaaagattccatatctgtccgagtttatgaactcattatatgagtgtcagtacaagtcatttttctcctcatttgctggcttgacggagcatatcaaattggatcgctacttgcaaccacacttcagatattatatgagggaggtcagaacagttgtgtactcccagttcctggagtcctacaagagtgttactattgaggccatggccaaggcttttggggtgtttgaggatttcatcgacttggaattatctcggttcattgcagctgggaagttgcattgcaagattgataaagtagcaggagtattggaaactaatcgtcctgatgcaaagaatgctctttatcaggcaacgatcaagcaaggggacttcttgttgaaccgcattcaaaagctttctcgtgtcattgatctctga

SEQ ID NO: 14273 - protein, 386 aa, Capsicum annuum
MDSEEGTQQPQLVLAHKLFRLTHPDVNDLDKVRLREEVLEAVLSNDMVPLYETLVTNGVLSLDQKVLDSMRAKNCDELKKLDDKIADAEENLGESEVREAHLAKSLFYIRIGDKEKALEQLKVTESKTVAVGQKMDLAFYTLQMGLFDLDFDLISKSIDKAKKLFEEGGDWERKNRLKVYEGLFCMSTRNFKKAADLFLDSISTFTTYELFPYDTFIFYTVLTSIITLDRVSLKQKVVDAPEILTVIGKIPYLSEFMNSLYECQYKSFFSSFAGLTEHIKLDRYLQPHFRYYMREVRTVVYSQFLESYKSVTIEAMAKAFGVFEDFIDLELSRFIAAGKLHCKIDKVAGVLETNRPDAKNALYQATIKQGDFLLNRIQKLSRVIDL

SEQ ID NO: 14274 - DNA, 1170 bp, Oryza sativa
  CDS (1)..(1170)
atggacggcggcgtaggcgaggaagggaagcagcagccgcacctggtgctggcgcacaagctgttcctgctctcgcacccggacgtggacgacctcgccaaggtcgacctccgcgccgatgtcctcgccgcagtcaaatccgatgatatggcgtctctgtacgagtcgctgggggccggcggcgtgctggagacggacgctgcgctgctcgcggagatgcgcggcaggatcgaggaggagatccggaagcttgacgagaagatcgctgatgctgaagagaatttgggtgagagtgaagtgcgtgaagcccatctagccaaatcgttgtatttcataagggttggagagaaggagaaggcactagaacagcttaaagttactgaaggaaaaactgtagctgttgggcaaaagatggaccttgttttccacactttacagattgggtttttctatatggattttgatctcatctctaagtctattgacaaagccaaaaaattgtttgaggagggtggtgattgggagaggaagaacagattgaaagtgtacgagggcttatactgcatggccactagaaacttcaagaaagctgcaagcttatttttggattcaatttcaacattcacaacctatgagttgttcccctatgatacattcatattctacacagttcttacaagtgttatctcattggatcgtgtatccctaaaggcaaaggttgtagatgcacctgagatcctggctgtaattggcaaagtacctcacctctctgagtttctcaactccctctacaattgccagtacaagtcattttttgccgcattctctggcttgacggagcagatcaagttagaccgttacctgcagcctcatttccgttactacatgcgtgaagtccgtactgttgtctattcacaattcctcgagtcctacaagagtgtgacgatggaagcaatggcttctgcatttggtgtgaccgttgatttcatagacctggaattgtcacgcttcattgctgctggaaagctccactgcaagatcgataaggttgctggcgtcctggagacgaaccggcctgatgccagaaatgctttctaccaggcaaccatcaagcaaggggacttcctgctgaaccgcatccagaagctatcacgagtcattgacctgtag

SEQ ID NO: 14275 - protein, 389 aa, Oryza sativa
MDGGVGEEGKQQPHLVLAHKLFLLSHPDVDDLAKVDLRADVLAAVKSDDMASLYESLGAGGVLETDAALLAEMRGRIEEEIRKLDEKIADAEENLGESEVREAHLAKSLYFIRVGEKEKALEQLKVTEGKTVAVGQKMDLVFHTLQIGFFYMDFDLISKSIDKAKKLFEEGGDWERKNRLKVYEGLYCMATRNFKKAASLFLDSISTFTTYELFPYDTFIFYTVLTSVISLDRVSLKAKVVDAPEILAVIGKVPHLSEFLNSLYNCQYKSFFAAFSGLTEQIKLDRYLQPHFRYYMREVRTVVYSQFLESYKSVTMEAMASAFGVTVDFIDLELSRFIAAGKLHCKIDKVAGVLETNRPDARNAFYQATIKQGDFLLNRIQKLSRVIDL

SEQ ID NO: 14276 - DNA, 1476 bp, Aspergillus oryzae
  CDS (1)..(1476)
atggggtccgacccgcagtatatcaagttccccgatcttaccctcgcccaacatgtcttcaacctctccaacccatcgtgcccgcagacggtgcggcaaacgtcgttgaagaaggtccaggatgctatctctgagaataaaatggcgcctttctataggcatcttgcccaccccgtggaaggcatcctgaaccattccggtgaaggcgttccccagcaccaagctagctcaactaagtccctgatcacctcgaatatgctggcatctcgaaagtcacctcaaaagatcgactttccatgggatgaatccttataccagtcgctagtcgaggataataagaaggagttggatgctttccaaaaggaggaagatgaggcggaagaagcagccggagacactgaggtgcttgcggcccgtgggaagcgtgctgagttctgggcgcgcgtaggagataaggataaagccatcgaatctcatgaagcactcctcgaaaagacgacattcctcggaaccaagattgacttggtgctggccatgatccgtattggactcttctttggtgacaccctgtctgtgagaaaaaacattgaacgggcaaacacgcttatcgagagcggtggtgactgggatcggaggaatcgtctcaaggcgtataagggcttacacttgctcacgattcgatcctacagcgtcgctgctcccttacttcttgacagtctgtctactttcacgagctacgaactctgcagctattctgcattggtcatttactccgtcctcgcaggttcactgtcgttgaagcgggtcgacttcaaagctaaagttgtggatgcaccggagatcaaggctatccttgggtccggagaagatcgggtagcggctttaactggggaggtgtcgtctggccccggtgcaaaggacgaagaaatgaaggatgcttctacatctagagccactccaggtgccgctaccaccgccgttaatttgaccaccctgggggctggctctgggatccaggctgaggccgaagcccctgttgacttctcgcctcttgccaacttggttagcagtctatataatggcaactaccggtcattcttcgtggccttggcggccgttgaagacaatttcctgactcaggaccggtacttgtatgaacaccgcgcttggtttgtccgtgagatgagactccgcgcctaccagcagcttctccagagctaccgggtggtaggattgaacagcatggccagcgattttggagttacagtggactttttggaccgggatctggccaagttcatcgctagcaatcgcatcgcatgcactatcgaccgagtaaatggcatcatcgaaacaaaccgccccgatgacaagaacaaacagtacgccgacgtcgtcaagcatggcgatgctctaattacgaaacttcagaagtatggccaggctgtgcgactgcgcggaagtgaacggagctaa

SEQ ID NO: 14277 - protein, 491 aa, Aspergillus oryzae
MGSDPQYIKFPDLTLAQHVFNLSNPSCPQTVRQTSLKKVQDAISENKMAPFYRHLAHPVEGILNHSGEGVPQHQASSTKSLITSNMLASRKSPQKIDFPWDESLYQSLVEDNKKELDAFQKEEDEAEEAAGDTEVLAARGKRAEFWARVGDKDKAIESHEALLEKTTFLGTKIDLVLAMIRIGLFFGDTLSVRKNIERANTLIESGGDWDRRNRLKAYKGLHLLTIRSYSVAAPLLLDSLSTFTSYELCSYSALVIYSVLAGSLSLKRVDFKAKVVDAPEIKAILGSGEDRVAALTGEVSSGPGAKDEEMKDASTSRATPGAATTAVNLTTLGAGSGIQAEAEAPVDFSPLANLVSSLYNGNYRSFFVALAAVEDNFLTQDRYLYEHRAWFVREMRLRAYQQLLQSYRVVGLNSMASDFGVTVDFLDRDLAKFIASNRIACTIDRVNGIIETNRPDDKNKQYADVVKHGDALITKLQKYGQAVRLRGSERS

SEQ ID NO: 14278 - DNA, 1467 bp, Aspergillus niger
  CDS (1)..(1467)
atggggtccgatccgcagtacataaagtaccctgatctcaacctcgcccaacatgtcttcaacctctccaaccctgcatgcccgcaaacagtgcgacagacatcattgaagagacttcaagatgttatctccgagaacaagatggctccattctaccgacacctcgctcatcccgttgaaggcattctgaaccactctggtgaaggtgtcgcccagcacccgaccaagtccctgattacgtcaaatatgctggcttcgcggaagtcgcctcagaacatagactttccctgggatgaatccctgtaccagtcattggtggaagacaaccggaaggagttggaagccttccaaaaggaggaggatgaagctgaggaagccgccggggaaactgaggtgctggccgcacggggtaagcgcgccgagttctgggcacgtgtaggcgataaggacaaagctatcgaatcccacgaggccctccttgagaagacgacattcctcggaaccaagatcgacctgatgctggctataatccggattggccttttcttcggggatacccattctgtcaagaagagcattgagcgggcaaacactctcattgaaagtggaggagactgggaccggagaaaccgcctcaaggcatacaagggcctacatctactcaccatccgttcatacagtcttgctgcccctctgctcctggacagtctatcgaccttcaccagctacgaactgtgcagctactcgtccctggtcatctattcgatccttgcgggctcattatccctgaagcgagtcgacttcaaggcaaaggttgtggatgcacccgagatcaaggccattcttggacctggagaggaccgcctagctgctctgaccggcgagatatcctccgggccgggtgcccaggatgaggagatgaaggatgctactgtcaccagagcggcgccgaccacggctaccactgtggttaacctcactactctgggagcgggatctggcatccagtctgaagccgaagcgcccgtggacttttcgcctcttgcaaacctggtagacagcctgtacaccggcaactaccggaatttcttcgtagcgctggcagccgtggaggacaacttcctgaaccaggaccgttacttgcacgaacaccgcgcgtggtttgtgcgcgagatgagacttcgtgcgtaccagcaactgctgcagagctatcgcgttgttggcctgaacagcatggccagcgactttggcgtcactgtagactacctggatcgggatcttgccaaattcattgccagcaaccggattgcatgcaccatcgatcgggtcaatggcatcatcgagacgaaccgaccagacgacaagaacaagcagtacgcggatgttgtgaagcacggcgatgccctgattacgaaactgcaaaagtacggacaagccgtgcggttgcgaggaagcgaacggagctag

SEQ ID NO: 14279 - protein, 488 aa, Aspergillus niger
MGSDPQYIKYPDLNLAQHVFNLSNPACPQTVRQTSLKRLQDVISENKMAPFYRHLAHPVEGILNHSGEGVAQHPTKSLITSNMLASRKSPQNIDFPWDESLYQSLVEDNRKELEAFQKEEDEAEEAAGETEVLAARGKRAEFWARVGDKDKAIESHEALLEKTTFLGTKIDLMLAIIRIGLFFGDTHSVKKSIERANTLIESGGDWDRRNRLKAYKGLHLLTIRSYSLAAPLLLDSLSTFTSYELCSYSSLVIYSILAGSLSLKRVDFKAKVVDAPEIKAILGPGEDRLAALTGEISSGPGAQDEEMKDATVTRAAPTTATTVVNLTTLGAGSGIQSEAEAPVDFSPLANLVDSLYTGNYRNFFVALAAVEDNFLNQDRYLHEHRAWFVREMRLRAYQQLLQSYRVVGLNSMASDFGVTVDYLDRDLAKFIASNRIACTIDRVNGIIETNRPDDKNKQYADVVKHGDALITKLQKYGQAVRLRGSERS

SEQ ID NO: 14280 - DNA, 1290 bp, Saccharomyces cerevisiae
  CDS (1)..(1290)
atggtagacgtggaagagaaaggtcaagaagttgaatatgttgatccaacggtgaatagggtgcccaattatgaggtatctgaaaaggcgtttcttttgacacaatcaaaggttagtattgaacagcgtaaggaagcggcagagttcgttttagccaaaattaaagaggaagaaatggccccttattataaatatctttgcgaggaataccttgttaataatggccaatctgacttggaacacgatgaaaagtcagattctttaaacgaatggatcaaatttgaccaggagctatacaatgaattgtgcaaaaaaaatgaaagtaagattaaagagttaaatgaaaagatccaaaaattggaagaagatgatgaaggtgaactagaacaagctcaagcctggattaatctgggtgaatattatgcacaaatcggtgacaaagataatgctgaaaagacgctagggaaatcattatcgaaggctatttccacaggcgccaaaattgatgttatgctaacaattgcaaggctggggttcttttataacgaccaactttatgttaaggagaagttggaagcagtcaattctatgattgaaaaaggtggtgactgggagagaagaaatagatataaaacatactatggtatccactgcttggccgtaagaaactttaaggaagcggcaaagttattggtcgattctctagcaactttcacctctattgaattaacttcctatgaaagcattgccacatatgcatcggtcacaggtttattcactctggaaagaacagacctaaaatccaaagtcatcgattcacctgaattgttatctttaatctcaacaactgccgcactacaatctatctcgtcgttaacaatttccctttacgcgtccgattatgccagttactttccatatcttttggaaacatatgcaaatgttttgattccatgtaaatatttgaatagacatgcagatttctttgttagagaaatgagaagaaaagtctacgcacaattgttggaatcatataagactttgtcgctgaaatctatggcaagcgcatttggtgtttcggttgcgttcttggataacgacctgggtaagtttattccaaataagcaactaaattgtgtcattgatagagttaatgggatcgtagagaccaacaggccagacaacaaaaatgctcaataccatctgctagttaagcaaggtgacggtttgctaacaaaattacaaaaatacggtgcagcagtgagattgacagggtcagatcgtgtttga

SEQ ID NO: 14281 - protein, 429 aa, Saccharomyces cerevisiae
MVDVEEKGQEVEYVDPTVNRVPNYEVSEKAFLLTQSKVSIEQRKEAAEFVLAKIKEEEMAPYYKYLCEEYLVNNGQSDLEHDEKSDSLNEWIKFDQELYNELCKKNESKIKELNEKIQKLEEDDEGELEQAQAWINLGEYYAQIGDKDNAEKTLGKSLSKAISTGAKIDVMLTIARLGFFYNDQLYVKEKLEAVNSMIEKGGDWERRNRYKTYYGIHCLAVRNFKEAAKLLVDSLATFTSIELTSYESIATYASVTGLFTLERTDLKSKVIDSPELLSLISTTAALQSISSLTISLYASDYASYFPYLLETYANVLIPCKYLNRHADFFVREMRRKVYAQLLESYKTLSLKSMASAFGVSVAFLDNDLGKFIPNKQLNCVIDRVNGIVETNRPDNKNAQYHLLVKQGDGLLTKLQKYGAAVRLTGSDRV

SEQ ID NO: 14282 - DNA, 1164 bp, Arabidopsis thaliana
  CDS (1)..(1164)
atggacggtggagcggaaggatctcagcagcctcaccttattctagccaacaagctcttcctcctcactcatccagatgttccagacatcgagaaagtccagctcaagtctgaggttttggatttcatcagatcccatggtatggctcctttgtacgaaaccctaattgcctcttcggtgctggatttggatcaaagcttgttagagtctatgcgggccgctaatgaagaggagcttaagaagctcgacgagaagattgcagatgcagaagaaaatttgggtgaaagtgaagttcgtgaagctcatcttgctaaggctctgtatttcatcaggattagtgataaggagaaagctttggagcagctaaaactcactgaagggaaaactgttgctgttggacaaaaaatggacgtggtgttttatacgttacaacttgcttttttctatatggactttgatctggtatcaaagagcattgacaaagcaaaaaaattgtttgaagagggtggtgactgggagaggaagaaccggctaaaggtctatgaaggtttgtactgcatgtccaccagaaattttaagaaggctgccagcttattcctggattctatatcaaccttcacaacatatgaaatttttccatatgagaccttcatattctacaccgtcctgacaagcatcataactttggacagagtttcccttaagcaaaaggtcgttgatgcacctgagatcttaaccgtgcttgggaagattccattcctttctgagtttctgaactccttgtatgagtgccagtacaaggcgtttttctcagcatttgctggaatggcggtgcagataaagtatgaccgttacttgtacccgcatttccggttctacatgagggaagtcagaacagtggtgtactctcagtttttggaatcttacaaaagtgtgacagttgaagcaatggcaaaggcctttggcgtttctgtcgatttcatagaccaggagttgtcgcgcttcattgctgctgggaagcttcactgtaagatagacaaggttgcaggtgttttggagacaaaccgtcctgatgcaaagaatgcactttaccaggcaacaatcaagcaaggggatttcttgctaaaccgaatccagaagctgtctcgtgtgatcgatctgtga

SEQ ID NO: 14283 - protein, 387 aa, Arabidopsis thaliana
MDGGAEGSQQPHLILANKLFLLTHPDVPDIEKVQLKSEVLDFIRSHGMAPLYETLIASSVLDLDQSLLESMRAANEEELKKLDEKIADAEENLGESEVREAHLAKALYFIRISDKEKALEQLKLTEGKTVAVGQKMDVVFYTLQLAFFYMDFDLVSKSIDKAKKLFEEGGDWERKNRLKVYEGLYCMSTRNFKKAASLFLDSISTFTTYEIFPYETFIFYTVLTSIITLDRVSLKQKVVDAPEILTVLGKIPFLSEFLNSLYECQYKAFFSAFAGMAVQIKYDRYLYPHFRFYMREVRTVVYSQFLESYKSVTVEAMAKAFGVSVDFIDQELSRFIAAGKLHCKIDKVAGVLETNRPDAKNALYQATIKQGDFLLNRIQKLSRVIDL

SEQ ID NO: 14284 - DNA, 1170 bp, Oryza sativa
  CDS (1)..(1170)
atggacggcggcgtaggcgaggaagggaagcagcagccgcacctggtgctggcgcacaagctgttcctgctctcgcacccggacgtggacgacctcgccaaggtcgacctccgcgccgatgtcctcgccgcagtcaaatccgatgatatggcgtctctgtacgagtcgctgggggccggcggcgtgctggagacggacgctgcgctgctcgcggagatgcgcggcaggatcgaggaggagatccggaagcttgacgagaagatcgctgatgctgaagagaatttgggtgagagtgaagtgcgtgaagcccatctagccaaatcgttgtatttcataagggttggagagaaggagaaggcactagaacagcttaaagttactgaaggaaaaactgtagctgttgggcaaaagatggaccttgttttccacactttacagattgggtttttctatatggattttgatctcatctctaagtctattgacaaagccaaaaaattgtttgaggagggtggtgattgggagaggaagaacagattgaaagtgtacgagggcttatactgcatggccactagaaacttcaagaaagctgcaagcttatttttggattcaatttcaacattcacaacctatgagttgttcccctatgatacattcatattctacacagttcttacaagtgttatctcattggatcgtgtatccctaaaggcaaaggttgtagatgcacctgagatcctggctgtaattggcaaagtacctcacctctctgagtttctcaactccctctacaattgccagtacaagtcattttttgccgcattctctggcttgacggagcagatcaagttagaccgttacctgcagcctcatttccgttactacatgcgtgaagtccgtactgttgtctattcacaattcctcgagtcctacaagagtgtgacgatggaagcaatggcttctgcatttggtgtgaccgttgatttcatagacctggaattgtcacgcttcattgctgctggaaagctccactgcaagatcgataaggttgcttgcgtcctggagacgaaccggcctgatgccagaaatgctttctaccaggcaaccatcaagcaaggggacttcctgctgaaccgcatccagaagctatcacgagtcattgacctgtag

SEQ ID NO: 14285 - protein, 389 aa, Oryza sativa
MDGGVGEEGKQQPHLVLAHKLFLLSHPDVDDLAKVDLRADVLAAVKSDDMASLYESLGAGGVLETDAALLAEMRGRIEEEIRKLDEKIADAEENLGESEVREAHLAKSLYFIRVGEKEKALEQLKVTEGKTVAVGQKMDLVFHTLQIGFFYMDFDLISKSIDKAKKLFEEGGDWERKNRLKVYEGLYCMATRNFKKAASLFLDSISTFTTYELFPYDTFIFYTVLTSVISLDRVSLKAKVVDAPEILAVIGKVPHLSEFLNSLYNCQYKSFFAAFSGLTEQIKLDRYLQPHFRYYMREVRTVVYSQFLESYKSVTMEAMASAFGVTVDFIDLELSRFIAAGKLHCKIDKVACVLETNRPDARNAFYQATIKQGDFLLNRIQKLSRVIDL

SEQ ID NO: 14286 - DNA, 1230 bp, Schizosaccharomyces pombe
  CDS (1)..(1230)
atgtgttctccctctgcaacactcacacaccgcaccatgacagaaaaggcaagaaccgtatcagatttgaccatttcgcaagcgattttcgagctttcctcgccattccttgagaataagagccaaaaggctttggatacgcttttttctgccattcgtgatcatgatttagctccactttataaatatctttcagagaaccctaaaacatcggcaagtattgattttgatagtaattttttaaatagtatgataaagaaaaatgaagaaaagttagcagagtttgacaaagcgatcgaagatgcccaagaacttaatggagaacatgaaattttagaagccatgaaaaacaaagctgattattatacgaatatatgcgatagagaacgtggtgtacagttatgcgatgaaacttttgaacgagcaacattgaccggaatgaagattgatgttcttttttccaaaatccgtttggcatacgtgtatgctgatatgagggtcgttggtcaattattggaaaaattaaagccacttattgaaaagggaggtgattgggagaggaaaaatcgattaaaggcctaccaaggcatatatttgatgtcaatccgtaatttttctggtgccgccgaccttctcttggattgtatgtcaactttctcttccaccgaactacttccatattacgacgtcgttcgatatgccgtgatttctggtgcaatttctttagatcgtgttgatgtcaagaccaaaatcgttgattcacctgaagtgcttgccgtgctacctcaaaatgaatcaatgtctagtttggaagcatgtatcaacagcttgtacttatgtgactattccggattttttcgaaccttggccgatgttgaagttaatcatcttaaatgtgatcaatttcttgtcgcccattatagatactatgtgcgtgaaatgagaagacgtgcttacgcccagttacttgaatcttaccgtgctctcagtatcgattccatggccgcttcctttggcgtatctgttgattatatcgatcgcgatttggcgtcatttatcccagacaacaagttgaactgtgtaattgatcgagtcaacggtgttgtatttacaaaccgtcctgatgaaaaaaaccgtcaataccaagaggttgttaagcagggtgatgttttacttaacaaactccaaaaataccaagccactgttatgcgtggtgcctttaaggtataa

SEQ ID NO: 14287 - protein, 409 aa, Schizosaccharomyces pombe
MCSPSATLTHRTMTEKARTVSDLTISQAIFELSSPFLENKSQKALDTLFSAIRDHDLAPLYKYLSENPKTSASIDFDSNFLNSMIKKNEEKLAEFDKAIEDAQELNGEHEILEAMKNKADYYTNICDRERGVQLCDETFERATLTGMKIDVLFSKIRLAYVYADMRVVGQLLEKLKPLIEKGGDWERKNRLKAYQGIYLMSIRNFSGAADLLLDCMSTFSSTELLPYYDVVRYAVISGAISLDRVDVKTKIVDSPEVLAVLPQNESMSSLEACINSLYLCDYSGFFRTLADVEVNHLKCDQFLVAHYRYYVREMRRRAYAQLLESYRALSIDSMAASFGVSVDYIDRDLASFIPDNKLNCVIDRVNGVVFTNRPDEKNRQYQEVVKQGDVLLNKLQKYQATVMRGAFKV

SEQ ID NO: 14288 - DNA, 1167 bp, Oryza sativa
  CDS (1)..(1167)
atggacgccggcggcgaggaggcgaagcaggagcgccacctggtgctggcccacaagctcttcctcctctcccaccccgacctcgacgacctcgccaaggtcgccctccgctccgacgccctcgacgccgtcaagtccgatggcatggcgccgctgttcgagtcgctggccgccgcgggcgtcctggagccggacgacgcgctgctcgccgagatgcgcgcgcggatcgacgaggaggtccgcaagctcgacgagaaaattgctgatgctgaagagaatttgggtgagagcgaagtgcgtgaggcccatctggcgaaatccttgtacttcatgagggttggagagaaggaaaaagcactggagcagcttaaagttactgaagggaaaactgtagctgttggccagaaaatggatcttgtgttctacactttgcaaataggccttttccacatggactttgatctcatctcaaaatccattgacaaggcaaagaacctgtttgaggaaggaggcgactgggagagaaagaaccgattgaaagtatatgaaggcctatacttcatggcaacgagaaacttcaagaaagctgccagcttatttttagattccatctcaactttcacaacttacgagttgtttccatatgatacttttgtcttctatacagtcatcacaagcataatcacattggatcgtgtatctctaaaacaaaaggtggtagatgcaccagaaattttggcagtgattggcaaagtacctcatctatctgagtttctgaactccctttacaattgccagtacaagtcattttttgttgcattctctggcatgacggagcagattaagttggatcgctatcttcagcctcatttccgctactatatgagggaagtgcggaccgttgtctattcacagtttttggagtcatacaagagtgtgacaatggaagcgatggccgcagcatttggtgtgactgttgatttcatagaccaggaattgtcgcggttcattgcagctgggaagcttcactgcaagatcgataaggttgctggtgttctggagacaaaccgacctgacgctaggaatgccttctaccaagcgaccatcaagcaaggggacttcttgctgaaccgcatccagaaactgtcacgagtcattgacttgtaa

SEQ ID NO: 14289 - protein, 388 aa, Oryza sativa
MDAGGEEAKQERHLVLAHKLFLLSHPDLDDLAKVALRSDALDAVKSDGMAPLFESLAAAGVLEPDDALLAEMRARIDEEVRKLDEKIADAEENLGESEVREAHLAKSLYFMRVGEKEKALEQLKVTEGKTVAVGQKMDLVFYTLQIGLFHMDFDLISKSIDKAKNLFEEGGDWERKNRLKVYEGLYFMATRNFKKAASLFLDSISTFTTYELFPYDTFVFYTVITSIITLDRVSLKQKVVDAPEILAVIGKVPHLSEFLNSLYNCQYKSFFVAFSGMTEQIKLDRYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 14290 - DNA, 1164 bp, Brassica napus
  CDS (1)..(1164)
atggacggtggagcagaaggaactcagcagcctcacctcattctagctcacaagctcttcctcctcacacatcccgatgttcaagacatcgagaaagtccagctcaagactgaggttttggattccatcaaatccgatgggatggctccattgtacgaaaccctagcggcctcctcggttctggagttggatcagagcttgttggattctatgcgggctaacaacgaggaagagcttaagaagctcgacgacaagattgcagatgcagaagaaaatttgggagaaagtgaagtccgtgaagctcaccttgctaaggctctgtatttcatcaggattagtgataaggagaaagctttagagcagctgaaactcactgaaggaaaaaccgttgctgttgggcaaaaaatggacttggtgttctatacgctgcagcttgccttcttctacatggacttcgatctcgtatccaagagcattgacaaagctaaaaagttgtttgaagagggtggtgactgggagaggaagaacaggctaaaggtctatgaaggcttgtattgcatgtccaccagaaactttaagaaggctgccagcttatttcttgattctatttcaacctttaccacttatgagatctttccctatgagaccttcattttctacaccgtcctgaccagcatcataactctcgacagagtttcacttaagcagaaggttgttgatgcacctgaaatcttgaccgtgcttgggaagattccgttcctttctgagttcctgaactccctgtacgagtgccagtacaaggcgtttttctcagcatttgctggaatggcagagcagataaagtttgaccgttacttgaacccacatttccgattctacatgagggaagtgagaacggtggtgtactctcagtttttggaatcttacaagagcgttactgtcgatgccatggcaaatgcgtttggtgtttcggttgatttcattgatcaggagctgtcacgcttcatagcagctgggaagctccactgcaagatagacaaggtggcgggtgtactggagacaaaccgtccagatgcaaagaatgcgctttaccaggcaacgatcaagcaaggggatttcttgcttaacaggatccagaagctctctcgagtcatcgatctgtga

SEQ ID NO: 14291 - protein, 387 aa, Brassica napus
MDGGAEGTQQPHLILAHKLFLLTHPDVQDIEKVQLKTEVLDSIKSDGMAPLYETLAASSVLELDQSLLDSMRANNEEELKKLDDKIADAEENLGESEVREAHLAKALYFIRISDKEKALEQLKLTEGKTVAVGQKMDLVFYTLQLAFFYMDFDLVSKSIDKAKKLFEEGGDWERKNRLKVYEGLYCMSTRNFKKAASLFLDSISTFTTYEIFPYETFIFYTVLTSIITLDRVSLKQKVVDAPEILTVLGKIPFLSEFLNSLYECQYKAFFSAFAGMAEQIKFDRYLNPHFRFYMREVRTVVYSQFLESYKSVTVDAMANAFGVSVDFIDQELSRFIAAGKLHCKIDKVAGVLETNRPDAKNALYQATIKQGDFLLNRIQKLSRVIDL

SEQ ID NO: 14292 - DNA, 1161 bp, Linum usitatissimum
  CDS (1)..(1161)
atggatttccctgagggagctcagcagccgcatctggttctagctaacaagctcttcctcctgacccacccggatgtccaggatatcgagaaggtccgcatcaaggaggaggttttagataccatcaaaacccacgatatggcgcctttgtttgaaacgctggtagctgagtcattgctcgataaggatcagaccctcttggatccaatgcgggctaagatcgaggaggagctgaagaagctcgatgaaaagattgcagatgcagaagaaaacttgggcgaaagtgaagttagagaagctcatctagcaaaatccttgttctacattcgtattggcgacaaggagaaagcattggagcaactcaaagtaaccgaaagcaaaacggtcgcagttggacaaaagatggacttggtattctacaccttgcaactcggtttcttctacatggatttcgatctcatctctaagagcattgacaaggcaaagaacttgttcgaagagggaggtgactgggagaggaaaaaccgcctgaaggtgtacgaaggcctgtactgcatgtctactcgcaatttcaagaaggcagccgatttgtttctggattctatctcgaccttcaccacatacgagattttcccctatgacactttcatattctacaccgttctgacaagcatcatatccttggatagagtgtctcttaagcagaaggttgtggatgcgcctgaaatcctggctgttataggaaagatcccacatctctcggagtttcttaactcgctctacgattgccagtacaagtctttcttctccgctttcgctggcttgaccgagcagataaagttagaccggtatttgtacccgcatttccggtactacatgagggaggtgagaacggtggtgtactcccagttcctcgagtcctacaagagtgtaacaatcgaggcaatggcgaaggcattcggcgtgacagtggatttcatcgatctggagttgtcaaggttcattgcagcggggaaactacactgcaagatcgataaagtagctggggttcttgaaacgaaccgtcctgatgcgaagaacgctctttaccaggcaacgatcaagcaaggggacttcttgctgaacaggattcagaagctgtcccgggtgatcgacttgtag

SEQ ID NO: 14293 - protein, 386 aa, Linum usitatissimum
MDFPEGAQQPHLVLANKLFLLTHPDVQDIEKVRIKEEVLDTIKTHDMAPLFETLVAESLLDKDQTLLDPMRAKIEEELKKLDEKIADAEENLGESEVREAHLAKSLFYIRIGDKEKALEQLKVTESKTVAVGQKMDLVFYTLQLGFFYMDFDLISKSIDKAKNLFEEGGDWERKNRLKVYEGLYCMSTRNFKKAADLFLDSISTFTTYEIFPYDTFIFYTVLTSIISLDRVSLKQKVVDAPEILAVIGKIPHLSEFLNSLYDCQYKSFFSAFAGLTEQIKLDRYLYPHFRYYMREVRTVVYSQFLESYKSVTIEAMAKAFGVTVDFIDLELSRFIAAGKLHCKIDKVAGVLETNRPDAKNALYQATIKQGDFLLNRIQKLSRVIDL

SEQ ID NO: 14294 - DNA, 1682 bp, Brassica napus
  CDS (295)..(1458)
ttttggctttgtcaatgctttttgaaaccaaatcgaagtccatgtagaaaacgcaagctgcaatgtgtagaacacaaggtccatcttttgcccaacggcaacagtttttccttcagtgagtttgagttgctccaacgctttctccttatcactgatcctgatgaaatacagagctttagcaagatgagcttcacggacttcactttctccccaattttactactattcatctcctctctttctcagatccgtctcaaatgtttttctcttgagttgactgagtaagcagcagccatggacggtggagcagaaggatctcagcagcctcaccttattctagcccacaagctcttcctcctcactcatcccgatgtgcaggacatcgagaaagtccagctcaagtctgacgtcttggattccatcaaatccgatggtatggctcccttgtacgaaaccctaaccgcgtcttctgtgctggaattggatcagagcttgttagattctatgcgtgctaccaacgaggaagagcttaaaaagctcgacgagaagattgcagacgctgaagagaatttgggagaaagtgaagtccgtgaagctcatcttgctaaggctctgtatttcgtcaggattagtgataaggagaaagctctggagcaactgaaactcactgaaggaaaaaccgttgctgttggccaaaagatggaccttgtgttctatacattgcagcttgcctttttctacatggatttcgacctggtatccaaaagcattgacaaagcaaaaaagttgtttgaagagggtggtgactgggagaggaagaacaggctaaaggtctatgaaggcttgtactgcatgtccaccagaaactttaagaaggctgccagcttatttctggattctatctcaaccttcactacttatgagatctttccctacgagaccttcattttctacaccgtgctgacgagcatcataactctggatagagtttctcttaagcaaaaggttgttgacgcacctgagatcttgaccgtgcttgggaagataccattcctttctgagttcctgaactccctgtacgaatgccagtacaaggcgtttttctcagcatttgctggaatggcagagcagataaagtttgaccggtacttgaacccacacttccggttctacatgagggaagtgagaacagtggtgtactctcagtttctggaatcttacaagagcgtgacggttgatgccatggcaaatgcctttggtgtttcagtggacttcattgatcaggagctgtcacgcttcattgcagctgggaagcttcactgcaagatagacaaagttgcaggtgttttggagactaaccgtccagatgcaaagaatgcactttaccaggcaacaatcaagcaaggagatttcttgctaaacaggatccagaagctctctcgagtcatcgatctgtgagcgagcatgtcacacacatgtttctgttcctcgcactttcctcaaaaattgcaacaacttggaaactcaaaaagggtctatcttaaggtgtgagaaaccatatttgagatcaatacccgtctgttctcttgtttcttttgactctagttgtctcgactcttttgaatctagttgattcctttatcagtgagcaagtttgatccccaaaaaaaaaaaaaaaaaaa

SEQ ID NO: 14295 - protein, 387 aa, Brassica napus
MDGGAEGSQQPHLILAHKLFLLTHPDVQDIEKVQLKSDVLDSIKSDGMAPLYETLTASSVLELDQSLLDSMRATNEEELKKLDEKIADAEENLGESEVREAHLAKALYFVRISDKEKALEQLKLTEGKTVAVGQKMDLVFYTLQLAFFYMDFDLVSKSIDKAKKLFEEGGDWERKNRLKVYEGLYCMSTRNFKKAASLFLDSISTFTTYEIFPYETFIFYTVLTSIITLDRVSLKQKVVDAPEILTVLGKIPFLSEFLNSLYECQYKAFFSAFAGMAEQIKFDRYLNPHFRFYMREVRTVVYSQFLESYKSVTVDAMANAFGVSVDFIDQELSRFIAAGKLHCKIDKVAGVLETNRPDAKNALYQATIKQGDFLLNRIQKLSRVIDL

SEQ ID NO: 14296 - DNA, 1430 bp, Glycine max
  CDS (54)..(1214)
ggaatagctattttgttggaaggaggtaaaggaagttcgtgacaaaagcggcaatggaaggagaagagggttcccagcagccacagttggtgctcggggacaagctattccttcttcgacaacccgatgttcaagacattgacaaggttcgctacaaggaggatgttttcactcacatcaaccaaaacgatatggtccccttgtatgaaaccctagtggccgattccgtgttggacttggatcgtgccctcttggactctatgcgcgctaaaattcacgatgagctcgccaacctcgacgaaaagattgctgatgctgaggaaaacttaggagagagtgaagttcgtgaggctcacttggcaaaatccttgtttttcatccggattatggacaaggagaaagccttggaacatctcaaggtaacagaaaccaagacagttgctgttggccagaaaatggacttggtgttttatacattgcagcttggtttcttcgacatggattttgatctcgtttccaaaagcattgacaaagccaaaaacttgtttgaagaaggtggtgattgggaaaggaagaataggctgaaagtgtacgaaggcctgtactgcatgtccactcgaaatttcaagaaggctgccaagttgtttttggattctatttcaacctttaccacctgtgaactttttccctatgacacctttatattttatacagttttgaccagcattatatcattggatagagtttccctaaagcaaaaggtagtggatgctccagagatcttgacagtgattggcaaaatcccatatctttcagagtttttgaactccttatatgattgtcaatacaagtcttttttctcagcatttgctggcctgacagagcaaattaagttggaccgctatctgcatccacacttccgatattacatgagggaggtcagaaccgttgtttattcccaatttttggaatcttacaagagtgtgacaattgaagccatggcaaaagcctttggagtgacagaggatttcattgatgtggagctatcacgctttattgcagcagggaagcttcattgtaagattgataaagttgaaggtgttcttgaaactaatcgccctgatgctaagaatgctctttaccaagcaactattaagcaaggggacttcctattgaatcggatccagaaattgtcacgtgtgatagatctttaggtcattttttgcattttagactaaaagtttattggaaaggcagagataacgacaatttcacggtattttactacgagggtgaggcacggcatttctgtagtccatttgatgtgcaaatatgattaattaaatttgccaaatccaaatatgtcaatcagttttcaattgtttaaaaaaaaaaaaaaaaaactcgagactagttctctctctctctct

SEQ ID NO: 14297 - protein, 386 aa, Glycine max
MEGEEGSQQPQLVLGDKLFLLRQPDVQDIDKVRYKEDVFTHINQNDMVPLYETLVADSVLDLDRALLDSMRAKIHDELANLDEKIADAEENLGESEVREAHLAKSLFFIRIMDKEKALEHLKVTETKTVAVGQKMDLVFYTLQLGFFDMDFDLVSKSIDKAKNLFEEGGDWERKNRLKVYEGLYCMSTRNFKKAAKLFLDSISTFTTCELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTEDFIDVELSRFIAAGKLHCKIDKVEGVLETNRPDAKNALYQATIKQGDFLLNRIQKLSRVIDL

SEQ ID NO: 14298 - DNA, 1358 bp, Zea mays
  CDS (20)..(1186)
gcaaagtgagggcggcgagatgaacggcggcggggaggacgggaagcagcagccgcacctggtactggcgcacaagctgttcctcctgtcgcactccgacgtcgacgacctcgccaaggtcgacctacgcgctgacgtgttcgcggcagtcaaatccgatgacatggcagctctgtacgagtcgttggcggcggacggcgtactggagacggacgcggcgctgctggccgagatgcgcgccaggatcgacgaggagatccggaagctcgacgagaagattgctgatgcagaggagaacttgggtgagagtgaagtgcgtgaggcccatctcgccaaatccttatatttcataagggttggggagaaggagaaagcactggagcagcttaaagttactgaaggaaaaactgtagctgttgggcaaaagatggaccttgttttctacacactacaaattggattgttctatatggactttgatctcatctcgaagtccattgacaaagcgaaaaacttgtttgaggaaggtggtgattgggaaaggaagaacagattgaaagtatatgaagggttgtactgcatggcaactagaaacttcaagaaagctgctagtttattcttggattcaatttcaactttcacgacatatgagctattcacatatgatacattcatcttctacacagtcctcacgagtgttatatctctggaccgtgtatctctgaaacaaaaggttgtagatgcgcctgagatcttagccgtaattggcaaagtacctcacctctcagagtttctcaattccctctacaattgccagcacaagtcattttttattgcattctctggcttgactgaaccaatcaagttagagcgttacttgcagcctcattttcgctactacatgcgtgaagtgcgcactgttgtctactcacagtttctggaatcgtacaagagtgtgacaatggaagccatggctgctgcatttggcgtcacagtcgactttatagaccaggaactgtcacgcttcattgccgctgggaagctccactgcaagatagacaaagttgctggcgtcttggaaacgaaccgacctgatgctaggaacgccttctaccaggcaaccatcaagcaaggagacttcctgctgaaccgcatccagaagctgtcacgagttatcgacctgtaggggagagcccttcatgcaggacaggagcttgccttggttcctggagtgtacgagcggtgcttgactttcaatgggtctcagttgaagaagcttttagggatatttgtgttctgagaaattgtgttttgcactttttagcctaactacatgaagcccccaaaaaaaaaaaaaa

SEQ ID NO: 14299 - protein, 388 aa, Zea mays
MNGGGEDGKQQPHLVLAHKLFLLSHSDVDDLAKVDLRADVFAAVKSDDMAALYESLAADGVLETDAALLAEMRARIDEEIRKLDEKIADAEENLGESEVREAHLAKSLYFIRVGEKEKALEQLKVTEGKTVAVGQKMDLVFYTLQIGLFYMDFDLISKSIDKAKNLFEEGGDWERKNRLKVYEGLYCMATRNFKKAASLFLDSISTFTTYELFTYDTFIFYTVLTSVISLDRVSLKQKVVDAPEILAVIGKVPHLSEFLNSLYNCQHKSFFIAFSGLTEPIKLERYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 14300 - DNA, 24 bp, Artificial sequence
  primer
atggtagacgtggaagagaaaagt

SEQ ID NO: 14301 - DNA, 24 bp, Artificial sequence
  primer
tcaaacacgatctgaccctgtcaa

SEQ ID NO: 14302 - protein, 522 aa, Artificial sequence
  consensus sequence
  Variant (2)..(4): Xaa in position 2 to 4 is any amino acid
  Variant (6)..(9): Xaa in position 6 to 9 is any amino acid
  Variant (11)..(11): Xaa in position 11 is any amino acid
  Variant (13)..(36): Xaa in position 13 to 36 is any amino acid
  Variant (37)..(37): Xaa in position 37 is any or no amino acid
  Variant (40)..(41): Xaa in position 40 to 41 is any amino acid
  Variant (43)..(44): Xaa in position 43 to 44 is any amino acid
  Variant (46)..(53): Xaa in position 46 to 53 is any amino acid
  Variant (54)..(134): Xaa in position 54 to 134 is any or no amino acid
  Variant (136)..(137): Xaa in position 136 to 137 is any amino acid
  Variant (139)..(156): Xaa in position 139 to 156 is any amino acid
  Variant (158)..(159): Xaa in position 158 to 159 is any amino acid
  Variant (161)..(161): Xaa in position 161 is any amino acid
  Variant (163)..(164): Xaa in position 163 to 164 is any amino acid
  Variant (165)..(165): Xaa in position 165 is any or no amino acid
  Variant (168)..(168): Xaa in position 168 is any amino acid
  Variant (170)..(172): Xaa in position 170 to 172 is any amino acid
  Variant (174)..(186): Xaa in position 174 to 186 is any amino acid
  Variant (188)..(189): Xaa in position 188 to 189 is any amino acid
  Variant (191)..(199): Xaa in position 191 to 199 is any amino acid
  Variant (201)..(203): Xaa in position 201 to 203 is any amino acid
  Variant (204)..(204): Xaa in position 204 is any or no amino acid
  Variant (206)..(206): Xaa in position 206 is any amino acid
  Variant (208)..(208): Xaa in position 208 is any amino acid
  Variant (210)..(219): Xaa in position 210 to 219 is any amino acid
  Variant (221)..(222): Xaa in position 221 to 222 is any amino acid
  Variant (224)..(236): Xaa in position 224 to 236 is any amino acid
  Variant (238)..(238): Xaa in position 238 is any amino acid
  Variant (240)..(240): Xaa in position 240 is any amino acid
  Variant (247)..(247): Xaa in position 247 is any amino acid
  Variant (250)..(250): Xaa in position 250 is any amino acid
  Variant (252)..(252): Xaa in position 252 is any amino acid
  Variant (254)..(254): Xaa in position 254 is any amino acid
  Variant (256)..(261): Xaa in position 256 to 261 is any amino acid
  Variant (263)..(263): Xaa in position 263 is any amino acid
  Variant (265)..(266): Xaa in position 265 to 266 is any amino acid
  Variant (269)..(269): Xaa in position 269 is any amino acid
  Variant (271)..(272): Xaa in position 271 to 272 is any amino acid
  Variant (275)..(276): Xaa in position 275 to 276 is any amino acid
  Variant (280)..(281): Xaa in position 280 to 281 is any amino acid
  Variant (283)..(285): Xaa in position 283 to 285 is any amino acid
  Variant (287)..(291): Xaa in position 287 to 291 is any amino acid
  Variant (293)..(300): Xaa in position 293 to 300 is any amino acid
  Variant (302)..(302): Xaa in position 302 is any amino acid
  Variant (305)..(305): Xaa in position 305 is any amino acid
  Variant (308)..(308): Xaa in position 308 is any amino acid
  Variant (311)..(311): Xaa in position 311 is any amino acid
  Variant (313)..(313): Xaa in position 313 is any amino acid
  Variant (316)..(316): Xaa in position 316 is any amino acid
  Variant (318)..(325): Xaa in position 318 to 325 is any amino acid
  Variant (326)..(385): Xaa in position 326 to 385 is any or no amino acid
  Variant (387)..(391): Xaa in position 387 to 391 is any amino acid
  Variant (395)..(397): Xaa in position 395 to 397 is any amino acid
  Variant (399)..(400): Xaa in position 399 to 400 is any amino acid
  Variant (403)..(416): Xaa in position 403 to 416 is any amino acid
  Variant (417)..(417): Xaa in position 417 is any or no amino acid
  Variant (420)..(421): Xaa in position 420 to 421 is any amino acid
  Variant (423)..(427): Xaa in position 423 to 427 is any amino acid
  Variant (430)..(430): Xaa in position 430 is any amino acid
  Variant (432)..(434): Xaa in position 432 to 434 is any amino acid
  Variant (436)..(436): Xaa in position 436 is any amino acid
  Variant (438)..(438): Xaa in position 438 is any amino acid
  Variant (444)..(449): Xaa in position 444 to 449 is any amino acid
  Variant (452)..(453): Xaa in position 452 to 453 is any amino acid
  Variant (457)..(459): Xaa in position 457 to 459 is any amino acid
  Variant (461)..(461): Xaa in position 461 is any amino acid
  Variant (463)..(464): Xaa in position 463 to 464 is any amino acid
  Variant (466)..(467): Xaa in position 466 to 467 is any amino acid
  Variant (470)..(473): Xaa in position 470 to 473 is any amino acid
  Variant (475)..(475): Xaa in position 475 is any amino acid
  Variant (477)..(477): Xaa in position 477 is any amino acid
  Variant (480)..(480): Xaa in position 480 is any amino acid
  Variant (482)..(482): Xaa in position 482 is any amino acid
  Variant (483)..(484): Xaa in position 483 to 484 is any or no amino acid
  Variant (486)..(487): Xaa in position 486 to 487 is any amino acid
  Variant (494)..(495): Xaa in position 494 to 495 is any amino acid
  Variant (497)..(498): Xaa in position 497 to 498 is any amino acid
  Variant (500)..(503): Xaa in position 500 to 503 is any amino acid
  Variant (508)..(508): Xaa in position 508 is any amino acid
  Variant (511)..(513): Xaa in position 511 to 513 is any amino acid
  Variant (516)..(520): Xaa in position 516 to 520 is any amino acid
  Variant (521)..(521): Xaa in position 521 is any or no amino acid
PXXXLXXXXFXLXXXXXXXXXXXXXXXXXXXXXXXXXMAXXYXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXLXXXXXXXXXXXXXXXXXXIXXAXEXXXGEXEXXXAXXXXXXXXXXXXXKXXAXXXXXXXXXKXXXXGXKXDXXXXXXXXXXFXXDXXXXXXXXXXXXXLXEXGGDWERXNRXKXYXGXXXXXXRXFXXAAXLXXDSXXTFTXXEXXXYXXXXXYXXXXXXXXLXRVXLKXKVXDXPEXLXXXXXXXXXXXXXXXXXXXXXXXXXXXXXXXXXXXXXXXXXXXXXXXXXXXXXXXXXXXXXXXXXXXXLXXXXXSLYXXXYXXFFXXXXXXXXXXXXXXXYLXXHXXXXXREXRXXXYXQXLESYKXXXXXXMAXXFGVXXXFXDXXLXXFIXXXXLXCXIDXVXXXGXXETNRPDXXNXXYXXXXKQGDXLLXXXQKXXXXXXL

SEQ ID NO: 14303 - protein, 46 aa, Artificial sequence
  protein pattern
  Variant (2)..(2): Xaa in position 2 is any or no amino acid
  Variant (7)..(7): Xaa in position 7 is Ser or Thr
  Variant (8)..(8): Xaa in position 8 is Leu or Val
  Variant (9)..(9): Xaa in position 9 is Ser or Thr
  Variant (10)..(10): Xaa in position 10 is Ile, Leu, Met or Val
  Variant (11)..(11): Xaa in position 11 is Asp, Glu or Lys
  Variant (12)..(12): Xaa in position 12 is Ala or Ser
  Variant (15)..(15): Xaa in position 15 is any amino acid
  Variant (16)..(16): Xaa in position 16 is Ala or Asn
  Variant (18)..(18): Xaa in position 18 is Gly or Asn
  Variant (19)..(19): Xaa in position 19 is Ile or Val
  Variant (20)..(21): Xaa in position 20 to 21 is any amino acid
  Variant (22)..(22): Xaa in position 22 is Ala, Asp, Glu or Gln
  Variant (24)..(24): Xaa in position 24 is Ile or Leu
  Variant (26)..(26): Xaa in position 26 is any amino acid
  Variant (27)..(27): Xaa in position 27 is Asp or Glu
  Variant (29)..(29): Xaa in position 29 is Cys, Gly or Ser
  Variant (30)..(30): Xaa in position 30 is Lys or Arg
  Variant (33)..(33): Xaa in position 33 is Ala, Pro or Ser
  Variant (34)..(34): Xaa in position 34 is Ala, Asn, Gln or Thr
  Variant (35)..(36): Xaa in position 35 to 36 is any amino acid
  Variant (38)..(38): Xaa in position 38 is any amino acid
  Variant (40)..(40): Xaa in position 40 is any amino acid
  Variant (43)..(43): Xaa in position 43 is Lys or Arg
  Variant (45)..(45): Xaa in position 45 is Ala, Glu or Asn
  Variant (46)..(46): Xaa in position 46 is Cys or Gly
LXESYKXXXXXXMAXXFXXXXXFXDXXLXXFIXXXXLXCXIDXVXX

SEQ ID NO: 14304 - protein, 57 aa, Artificial sequence
  protein pattern
  Variant (7)..(7): Xaa in position 7 is Lys or Arg
  Variant (10)..(10): Xaa in position 10 is any amino acid
  Variant (12)..(12): Xaa in position 12 is Ala, Thr or Val
  Variant (14)..(14): Xaa in position 14 is any amino acid
  Variant (16)..(16): Xaa in position 16 is Ile or Leu
  Variant (17)..(17): Xaa in position 17 is Phe, His or Tyr
  Variant (18)..(18): Xaa in position 18 is any amino acid
  Variant (19)..(19): Xaa in position 19 is Leu or Met
  Variant (20)..(20): Xaa in position 20 is Ala or Ser
  Variant (21)..(21): Xaa in position 21 is any amino acid
  Variant (23)..(23): Xaa in position 23 is Asp or Asn
  Variant (25)..(26): Xaa in position 25 to 26 is any amino acid
  Variant (28)..(28): Xaa in position 28 is Ala or Ser
  Variant (29)..(29): Xaa in position 29 is any amino acid
  Variant (31)..(31): Xaa in position 31 is Phe or Leu
  Variant (32)..(32): Xaa in position 32 is any amino acid
  Variant (33)..(33): Xaa in position 33 is Asp or Glu
  Variant (34)..(34): Xaa in position 34 is Cys or Ser
  Variant (35)..(35): Xaa in position 35 is Ile, Leu or Met
  Variant (36)..(36): Xaa in position 36 is Ala or Ser
  Variant (39)..(40): Xaa in position 39 to 40 is Ser or Thr
  Variant (41)..(41): Xaa in position 41 is any amino acid
  Variant (43)..(43): Xaa in position 43 is Ile or Leu
  Variant (44)..(44): Xaa in position 44 is any amino acid
  Variant (45)..(45): Xaa in position 45 is Pro, Ser or Thr
  Variant (47)..(47): Xaa in position 47 is any amino acid
  Variant (48)..(48): Xaa in position 48 is Ala, Asp, Asn, Gln, Ser or Thr
  Variant (49)..(49): Xaa in position 49 is Phe, Ile, Leu or Val
  Variant (50)..(50): Xaa in position 50 is Ala, Ile or Val
  Variant (51)..(52): Xaa in position 51 to 52 is any amino acid
  Variant (53)..(53): Xaa in position 53 is Ala or Thr
  Variant (54)..(54): Xaa in position 54 is any amino acid
  Variant (55)..(55): Xaa in position 55 is Ile, Leu or Val
  Variant (56)..(56): Xaa in position 56 is Ala, Ser or Thr
  Variant (57)..(57): Xaa in position 57 is Gly or Ser
GGDWERXNRXKXYXGXXXXXXRXFXXAXXLXXXXXXTFXXXEXXXYXXXXXXXXXXX

SEQ ID NO: 14305 - protein, 26 aa, Artificial sequence
  protein pattern
  Variant (5)..(5): Xaa in position 5 is Ala, Glu, Asn or Ser
  Variant (6)..(6): Xaa in position 6 is Lys or Arg
  Variant (8)..(9): Xaa in position 8 to 9 is any amino acid
  Variant (11)..(13): Xaa in position 11 to 13 is any amino acid
  Variant (14)..(14): Xaa in position 14 is Ile or Val
  Variant (19)..(19): Xaa in position 19 is any amino acid
  Variant (22)..(22): Xaa in position 22 is Asn or Thr
  Variant (23)..(23): Xaa in position 23 is Lys or Arg
  Variant (24)..(24): Xaa in position 24 is Ile or Leu
NRPDXXNXXYXXXXKQGDXLLXXXQK

SEQ ID NO: 14306 - protein, 28 aa, Artificial sequence
  protein pattern
  Variant (2)..(4): Xaa in position 2 to 4 is any amino acid
  Variant (5)..(6): Xaa in position 5 to 6 is any or no amino acid
  Variant (8)..(9): Xaa in position 8 to 9 is any amino acid
  Variant (10)..(11): Xaa in position 10 to 11 is any or no amino acid
  Variant (14)..(15): Xaa in position 14 to 15 is any amino acid
  Variant (17)..(18): Xaa in position 17 to 18 is any amino acid
  Variant (19)..(19): Xaa in position 19 is Phe, Trp or Tyr
  Variant (20)..(20): Xaa in position 20 is Phe or Tyr
  Variant (21)..(21): Xaa in position 21 is Ile, Leu, Met or Val
  Variant (24)..(24): Xaa in position 24 is Met or Val
  Variant (26)..(27): Xaa in position 26 to 27 is any amino acid
  Variant (28)..(28): Xaa in position 28 is Ala or Val
EXXXXXLXXXXYLXXHXXXXXREXRXXX

SEQ ID NO: 14307 - protein, 25 aa, Artificial sequence
  protein pattern
  Variant (2)..(2): Xaa in position 2 is Gly, Thr or Val
  Variant (3)..(3): Xaa in position 3 is Asp or Ser
  Variant (6)..(6): Xaa in position 6 is any amino acid
  Variant (8)..(9): Xaa in position 8 to 9 is Ile or Val
  Variant (11)..(11): Xaa in position 11 is Ala or Ser
  Variant (13)..(13): Xaa in position 13 is Asp or Glu
  Variant (14)..(14): Xaa in position 14 is Ile, Leu or Val
  Variant (16)..(16): Xaa in position 16 is Ala, Ser or Thr
  Variant (17)..(17): Xaa in position 17 is Ile, Leu or Val
  Variant (18)..(18): Xaa in position 18 is any amino acid
  Variant (19)..(19): Xaa in position 19 is Gly, Asn, Pro, Ser or Thr
  Variant (20)..(21): Xaa in position 20 to 21 is any amino acid
  Variant (22)..(22): Xaa in position 22 is Ala or Pro
  Variant (23)..(23): Xaa in position 23 is any amino acid
  Variant (25)..(25): Xaa in position 25 is Glu, Gly, Gln or Ser
RXXLKXKXXDXPXXLXXXXXXXXLX

SEQ ID NO: 14308 - protein, 22 aa, Artificial sequence
  protein pattern
  Variant (2)..(2): Xaa in position 2 is Ala, Gln, Ser or Thr
  Variant (4)..(4): Xaa in position 4 is Ile or Met
  Variant (6)..(6): Xaa in position 6 is Ile, Leu or Val
  Variant (7)..(7): Xaa in position 7 is any amino acid
  Variant (8)..(8): Xaa in position 8 is Phe or Leu
  Variant (9)..(11): Xaa in position 9 to 11 is any amino acid
  Variant (12)..(12): Xaa in position 12 is Gln or Arg
  Variant (13)..(13): Xaa in position 13 is Ile, Leu or Met
  Variant (14)..(14): Xaa in position 14 is Ala, Glu or Gly
  Variant (15)..(15): Xaa in position 15 is Phe or Leu
  Variant (17)..(18): Xaa in position 17 to 18 is any amino acid
  Variant (20)..(20): Xaa in position 20 is any amino acid
  Variant (21)..(21): Xaa in position 21 is any or no amino acid
GXKXDXXXXXXXXXXFXXDXXL

SEQ ID NO: 14309 - protein, 29 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Asp or Glu
  Variant (7)..(7): Xaa in position 7 is any amino acid
  Variant (9)..(10): Xaa in position 9 to 10 is any amino acid
  Variant (11)..(11): Xaa in position 11 is Ala, Glu or Gln
  Variant (13)..(13): Xaa in position 13 is any amino acid
  Variant (14)..(14): Xaa in position 14 is Gly, Ile or Leu
  Variant (15)..(16): Xaa in position 15 to 16 is any amino acid
  Variant (17)..(17): Xaa in position 17 is Ala, Gly or Ser
  Variant (18)..(18): Xaa in position 18 is any amino acid
  Variant (19)..(19): Xaa in position 19 is Phe or Tyr
  Variant (20)..(20): Xaa in position 20 is Phe, Trp or Tyr
  Variant (21)..(21): Xaa in position 21 is any amino acid
  Variant (22)..(22): Xaa in position 22 is Gln or Arg
  Variant (23)..(23): Xaa in position 23 is Ile or Val
  Variant (24)..(24): Xaa in position 24 is any amino acid
  Variant (25)..(25): Xaa in position 25 is Asp or Glu
  Variant (26)..(26): Xaa in position 26 is Lys or Arg
  Variant (27)..(28): Xaa in position 27 to 28 is any amino acid
EXXXGXXEXXXAXXXXXXXXXXXXXXXXA

SEQ ID NO: 14310 - protein, 14 aa, Artificial sequence
  protein pattern
  Variant (2)..(2): Xaa in position 2 is any amino acid
  Variant (3)..(3): Xaa in position 3 is any or no amino acid
  Variant (7)..(7): Xaa in position 7 is Ala, Asp, Glu, Asn or Thr
  Variant (8)..(8): Xaa in position 8 is Cys, Gly or Ser
  Variant (9)..(9): Xaa in position 9 is Asp, Glu, Asn or Gln
  Variant (11)..(12): Xaa in position 11 to 12 is any amino acid
  Variant (13)..(13): Xaa in position 13 is any or no amino acid
LXXSLYXXXYXXXF

SEQ ID NO: 14311 - DNA, 1008 bp, Saccharomyces cerevisiae
  CDS (1)..(1008)
atgtcaaatattgtgggtattgaatataaccgtgtaacgaatacaacctccacggattttcctggtttctcgaaggatgcagaaaacgagtggaatgtggaaaaattcaaaaaggacttcgaagtcaatatttcgtcattagacgcaagagaggcaaatttcgacttgataaacattgacacatcgattgcgaatgcctttcgtcgtataatgatttccgaggttccatccgtggctgctgaatacgtctatttttttaacaatacatccgttatccaagatgaggttttggctcatagaataggcttggttccattaaaagttgaccctgatatgctcacatgggttgatagtaatttgccggacgatgaaaagtttacggatgaaaatactatcgttttgagtttgaacgtgaagtgcacaagaaatccagatgctccaaagggatctactgatccaaaggaactatataacaatgcccatgtctacgcccgtgatttgaagtttgaaccacagggcagacaatctaccacttttgctgattgtccggttgttccagctgatcctgatattttattagctaagctaaggcctggtcaagaaatttcgttgaaggcacattgcattttaggtatcggtggtgatcatgctaaattttcaccagtttccaccgcttcttatagattattacctcaaatcaatatcttacagccaatcaaaggtgaaagtgccagaagatttcaaaaatgttttcccccaggtgttattggtattgatgaaggttcagatgaagcgtatgtcaaagatgctaggaaggatacggtttccagggaggttttaagatacgaagagtttgctgataaagttaaattaggaagagtgaggaaccactttattttcaacgtagaaagcgctggtgccatgacaccagaagaaatttttttcaaatccgtcaggattttaaagaataaggctgagtatttgaaaaactgtccaattacccaatga

SEQ ID NO: 14312 - protein, 335 aa, Saccharomyces cerevisiae
MSNIVGIEYNRVTNTTSTDFPGFSKDAENEWNVEKFKKDFEVNISSLDAREANFDLINIDTSIANAFRRIMISEVPSVAAEYVYFFNNTSVIQDEVLAHRIGLVPLKVDPDMLTWVDSNLPDDEKFTDENTIVLSLNVKCTRNPDAPKGSTDPKELYNNAHVYARDLKFEPQGRQSTTFADCPVVPADPDILLAKLRPGQEISLKAHCILGIGGDHAKFSPVSTASYRLLPQINILQPIKGESARRFQKCFPPGVIGIDEGSDEAYVKDARKDTVSREVLRYEEFADKVKLGRVRNHFIFNVESAGAMTPEEIFFKSVRILKNKAEYLKNCPITQ

SEQ ID NO: 14313 - DNA, 1562 bp, Oryza sativa
  CDS (190)..(1329)
gaccgcaactccggccgcccgccgccgccgccgccgctcgcgtgcagcaagcgttgtgctagctagcgccgccccacccctccggtgccgactagttgctgtggctggcggcgcgcgccgcctgacttcctctccttctccggtgcctcacctcaggctctgttgagaacaggaggggtgagggggaagatgccgaagaaggggacgaaatcgaggaagggcacggacgatgagcccaagcaggaggagaagaacaagcttccggagcaccttgaggtccagcggacgcgtgtggtctgcaagggcgacgcccccgtaaatactgaaggttttcaatacgctggtgcttttgctgctatgggaatcgataacagtgtctcagcggataagttttgcaaaaactttaaagtcgtggtaaatcgacttacggaagatgatatggagtttgatatgattggtattgatgcatcaatggctaatgcttttcggagaatccttatagcagaggttcctacaatggcaattgagaaagttttaatggctgacaatacctcagttatagcagatgaagttctttcacatagacttggccttattccacttgatgcagatcctaggctttttgaatatatctcagaaaatgatgtcccaactgaaagaaacactattgtgtacaaactccatgtttcatgtaaaaagggttccccacggcttacagtgaagtctggtgatttagagtggctgccagaaggtagccaactacctttggcatctcctgctcaatctggggacaaacaaaagacgtacacttccttcagccaaagccagaaggatatcttagaaaagcctcttggtgtgaaatttaaagacataactattgcgaggcttgggccaggccaggctattgaacttgaggtacatgctgttaagggaataggaaaagtgcatgccaagtggtccccagttgctacagcttggtatagaatgctccctgaggttgttcttcgtgaagaaatcaaagatgctgatgcagagatgctagtggcaaagtgcccagtcaatgtttttgacatcgaagacctgggaaacggggaaaagagagcggttgttgctaggccaagagcatgcaccctttgtaggcaatgcgttatgggacctactggggaagttatgggacctactgtggaacaagtagaactacggcgtgtcagagaccacttcatctttacgattgagtctactggagctctaccgccggagatgctgttcacagaggctgtgaggatcctcgaggagaagtgcgagagagtgatatctggactgtcatgagctctctagtggtcactgtagtttttcacggttatattctgttgggagggtgtttgtgctaagatttatctcctgacgaagagctgagttggtaatgtttcttataatcttgtctacatcaggctgctgtaacagaaacaaattaaagctcggcattggttttttgttgttccagtttaccatgcaccctagttgcagtttacagtacttgttattcaggcactacgatttgc

SEQ ID NO: 14314 - protein, 379 aa, Oryza sativa
MPKKGTKSRKGTDDEPKQEEKNKLPEHLEVQRTRVVCKGDAPVNTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTVKSGDLEWLPEGSQLPLASPAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTVEQVELRRVRDHFIFTIESTGALPPEMLFTEAVRILEEKCERVISGLS

SEQ ID NO: 14315 - DNA, 1590 bp, Glycine max
  CDS (253)..(1434)
aattcggctcgagcaagcaggagccttacaaccttcctaactcttatgagtggacaacacgagctcatgatccttaacacagttattggtgcgcaggacattatgttgcgcacagatcttctcagacagcattacggcctaaacggctaaacccctccatgttgctttctacactcattgcaacgaattgctaacgtcccacacgctacagagaagatacgacagagtgagagagaaagaagcacaacaaggatgtcttcgtcgtcatcgtcgtcgtcgtcgtcggaagatgaatctatgtcggaacagagcaatgaattaggacttgatttcatcttgagcttggacaatgttccatcaaagctccctccacacctcgaactctttaaaacacgtgttctttgcaacaacgatgctcctgtgcacactgatactgtacaatattctggtgcctatgctattttaggagttgataatagtgtgcggttggatagcttctgtgaaaactttaaggttgaagtgaagcggcttacggatagcgatattgaatttgatatgattggaatcgatccggcaattgccaatgcatttcgaagaatccttatagcagaggttccaacaatggctattgaaagagtatatatcgcaaacaatacatcggttgtacaagatgaagttctttcccatagattgggtctcattccaattcgtgctgatcccaggctatttgaatatccagaaaatgcaggagatgacaagaatgaaaagaacaccattgtcttcaagctacatgttcgttgtcaagtgggtcaacctcgtattactgtaaaatcagataaactgaagtggttacctaatgggagtgagcttccctgtgaagatgtcaaaccaaatgcaggttcaaaaccaaaaacatttacatctttcacttgcagccaagattcacttcctgaattttccaacaattcaattggtcttacatattcggatattatattggctaaacttggacctggtcaggaaattgaacttgaagcacatgcagttaaaggcattggtaagacacatgcaaaatggtccccagttgccactgcttggtaccggatgcttccggaggttgtactcttggaagctgttgaggatgagctggctgaagaattaaaaaataagtgtccagttaatgtgtttgatattgaagacattggaaaaggtaaaagaagggcaaaagtagccagaccacgggattgcactttgtgtagggaatgcatcagagggggcaaagaatgggaagatcgtgtatcattacgccgtgttaaaaatcatttcatttttactattgaatcaactggagcattaccccctgaagtgctatttactgaagctgtgaagattttggaagataaatgtgaacgtgtgattactgagctttcttgattcttattttttgccatgtcttaaaatcaatgaaatggataaatgtgatccttgattcagttctgttatgattccatttttttttatactttgaaagttcttttctaagttctttccttactcataaaaaaaaaaaaaaaaaaaaaaaaaaaaaaa

SEQ ID NO: 14316 - protein, 393 aa, Glycine max
MSSSSSSSSSSEDESMSEQSNELGLDFILSLDNVPSKLPPHLELFKTRVLCNNDAPVHTDTVQYSGAYAILGVDNSVRLDSFCENFKVEVKRLTDSDIEFDMIGIDPAIANAFRRILIAEVPTMAIERVYIANNTSVVQDEVLSHRLGLIPIRADPRLFEYPENAGDDKNEKNTIVFKLHVRCQVGQPRITVKSDKLKWLPNGSELPCEDVKPNAGSKPKTFTSFTCSQDSLPEFSNNSIGLTYSDIILAKLGPGQEIELEAHAVKGIGKTHAKWSPVATAWYRMLPEVVLLEAVEDELAEELKNKCPVNVFDIEDIGKGKRRAKVARPRDCTLCRECIRGGKEWEDRVSLRRVKNHFIFTIESTGALPPEVLFTEAVKILEDKCERVITELS

SEQ ID NO: 14317 - DNA, 1711 bp, Zea mays
  CDS (286)..(1404)
ccggccggaaaaaaaaccagccgccactgtttctcgttctcccatcatgcttcttcctcgcagtgccggcgctccatcttccgctcgctcccttgctcgtgctcggcacgcaggcgacggaggctgcgttcgggctcgggctctcagcaaccgcgtcagcggctgcccctcccgcttctcgccagtcgccccgtgccctcgcctccggtcctcagcacaccagccgtgaccctgcgtcataactgcggtacaagggtgaacaaagaacatcgagaggaagacaatatgccgaagaaggggactaaatctaagaaggagaaggtggacgatgtgcccaatgaacaagaaaataagcttccagactacctggagctccagcgcacacgtgtcgtctgcaatgctgatgcccccattcatactcaaggtttccaatactcgggtgcatttgctgctatgggaattgataatagcgtgtcagtggataaattttgcaagaatttcaaaattgaaataaatcgtctcactgaagatgatatggagttcgatatgattggtattgatgcatcaatagccaatgctttccggagaatcctcatttcagaggttccaactatggcaattgagaaagtcttcatggctgacaacaactcagttatagcagacgaggttctttcacatagactaggacttattccacttgatgcagatccaagactctttgaatatatctcagaaaacgatgtcccaaatgaaaggaatactattgtttataaactgcacgtttcttgtccaaagaattctcaacgaattacagtgaaatctagtgaactagagtggttaccagaaggtagccaattaagcatgtcagcccctgcacagtctggagacaaacagaagactttcacttccttcagtcaaagccaaaaggagatcttagaaaagcctcttggtgtgaagtataaagatattactattgccaggcttgggccaggacaggctatcgagctcgaggcacatgctgttaagggaactgggaacgttcacgccaagtggtctccagttgctacagcctggtacagaatgctccctgaggttgttattcttaaagaagttgaaggccctcaggcagaggagctggtgaataagtgccgggttaatgtttttgacatcgaagacctggctaacggtggaaagagggctgttgttgcgaggccaagggcatgcacgctctgcagagaatgtgtgatgggaccaaatgagaaacaagtggagctacggcgtgtcagagaccatttcatattcaccatcgagtccaccggaagcatgcccccggaggtgctgttcacagaagccgtgaagattttggaagagaagtgcgagagggtcatatctgagctctcctgattcctgagaggccggcggcactgtgcagcactggagttagagtaaaccagctcagcctgcagtatctgctgtttttgctggagactagtgtgcgccattaaacattttttttggtggtgttggatatttgggtcagcaaatgtaagctgtttatatatcatgtaacgcagtgtaatgttagattaaactgtggcaggtgatcgaaatggcagctgtatcaaaggtagacgtcggctgttagtccgcaagtgtaacagcccaaaatcataattttgggtttagaaccctccaaataaaaatttccatt

SEQ ID NO: 14318 - protein, 372 aa, Zea mays
MPKKGTKSKKEKVDDVPNEQENKLPDYLELQRTRVVCNADAPIHTQGFQYSGAFAAMGIDNSVSVDKFCKNFKIEINRLTEDDMEFDMIGIDASIANAFRRILISEVPTMAIEKVFMADNNSVIADEVLSHRLGLIPLDADPRLFEYISENDVPNERNTIVYKLHVSCPKNSQRITVKSSELEWLPEGSQLSMSAPAQSGDKQKTFTSFSQSQKEILEKPLGVKYKDITIARLGPGQAIELEAHAVKGTGNVHAKWSPVATAWYRMLPEVVILKEVEGPQAEELVNKCRVNVFDIEDLANGGKRAVVARPRACTLCRECVMGPNEKQVELRRVRDHFIFTIESTGSMPPEVLFTEAVKILEEKCERVISELS

SEQ ID NO: 14319 - DNA, 1387 bp, Triticum aestivum
  CDS (160)..(1227)
cgaaaagcgcccagcaagcttgtatattcgctcagcctctctctctcttctccttacccagccgcctcgtgcccttgtcctctcccgtctccgaccgcgccgccgccactaggccacgaccgccgccccctcccccagcctcgcttcgctccggcggggatggaaaaccgcgatggttcctcattgccagactttcttgagctccagcgcacccgtgttctctgcaaggccgatgcccccactcatacagaggggtttcaatactcgggggcttttgctgctatgggagttgatactagtgtctcagttgagaagttctgcaagaactttaaaatcgagataaatcgacttacagatgaggatatggagtttgatatgattggcgttgatgcatcgatagctaatgctttccggagaatcctcattgcagaggttcctacaatggccattgagaaagtcttcatggttgacaatacatcagttatagcagatgaggtcctttcacaccgactaggccttattccacttgatgctgatccaaggctttttgattatatctctgatgatgtcccaaatgaaaggaatactattgtgtacaaactgcatgtttcatgtgaaaagggttcccaaagacttacagttaagtctggtcaattggagtggttgccagaaggcagtcaattaactatggcatctcctgcgcaatctggggacaatcagaggacctacacatcctttggtcaaagccaacagaatacctctgaaaggcctctcggtgtgaagtataatgacataacaattgccaggcttgggccaggacaggctattgagcttgaggcacatgctgttaagggagtggggaaagttcatgcgaagtggtctccagttgctacagcctggtacaggatgctccccgaggttgttcttctcaaagaaattaaaaatggtgatgcagaggagctagtgaaaagatgcccagttaatgtttttgacattgaagacctgggaaagggggagaagagagcagttgttgcaaagccaagagcatgcaccctttgtagggaatgtgtcagactggctgatgatcaagtagagctacggcgtgttagagaccacttcatttttacaatcgagtccaccggagctctaccgccggaggtgctcttcacagaggccgtgaagatccttgaggagaagtgcgagcgagtgatatccgaactttcctgagcccgacataaagttttcagtactgttctgatgcagtttttctattgctatgttgtgctgaggacgaaatcttagtgtactagtataggttactgtaaaacttctgcatccaatactctggagtcacattcagctaatttattaccgagccggtatatgc

SEQ ID NO: 14320 - protein, 355 aa, Triticum aestivum
MENRDGSSLPDFLELQRTRVLCKADAPTHTEGFQYSGAFAAMGVDTSVSVEKFCKNFKIEINRLTDEDMEFDMIGVDASIANAFRRILIAEVPTMAIEKVFMVDNTSVIADEVLSHRLGLIPLDADPRLFDYISDDVPNERNTIVYKLHVSCEKGSQRLTVKSGQLEWLPEGSQLTMASPAQSGDNQRTYTSFGQSQQNTSERPLGVKYNDITIARLGPGQAIELEAHAVKGVGKVHAKWSPVATAWYRMLPEVVLLKEIKNGDAEELVKRCPVNVFDIEDLGKGEKRAVVAKPRACTLCRECVRLADDQVELRRVRDHFIFTIESTGALPPEVLFTEAVKILEEKCERVISELS

SEQ ID NO: 14321 - DNA, 1387 bp, Triticum aestivum; identical to SEQ ID NO: 14319
  CDS (283)..(1227)

SEQ ID NO: 14322 - protein, 314 aa, Triticum aestivum
MGVDTSVSVEKFCKNFKIEINRLTDEDMEFDMIGVDASIANAFRRILIAEVPTMAIEKVFMVDNTSVIADEVLSHRLGLIPLDADPRLFDYISDDVPNERNTIVYKLHVSCEKGSQRLTVKSGQLEWLPEGSQLTMASPAQSGDNQRTYTSFGQSQQNTSERPLGVKYNDITIARLGPGQAIELEAHAVKGVGKVHAKWSPVATAWYRMLPEVVLLKEIKNGDAEELVKRCPVNVFDIEDLGKGEKRAVVAKPRACTLCRECVRLADDQVELRRVRDHFIFTIESTGALPPEVLFTEAVKILEEKCERVISELS

SEQ ID NO: 14323 - DNA, 1294 bp, Triticum aestivum
  CDS (57)..(1124)
cccgtctccgactgcgccgccgccccctcccccagcctcgcttcgctcccgcggggatggaaaaccgcgatggttcctcactgccagactttcttgagctccagcgcacccgtgttctctgcaaggccgatgcccccactcatacagaagggtttcaatactcgggtgcttttgctgctatgggagttgacactagtgtttcagttgagaagttctgcaagaactttaaaatcgagataaatcgacttacagatgaggatatggagtttgatatgattggcgttgatgcatcgatagctaatgctttccggagaatcctcattgcagaggttcctacaatggccattgagaaagtcttcatggttgacaatacctcagttatagcagatgaggtcctttcacaccgactaggccttattccacttgatgctgatccaaggctttttgattatatctctgatgatgtcccaaatgaaaggaacactattgtgtacaaactgcatgtttcatgtgaaaagggttcccaaaggcttacagttaagtctggtcaattggagtggttgccagaaggcagtcaattaactatggcatctcctgcgcaatctggggacaatcagaggacctacacatcctttggtcaaagccaacagaatacctctgaaaggcctctcggtgtgaagtataatgacataacaattgccaggcttgggccaggacaggctattgagcttgaggcacatgctgttaagggagtggggaaagttcatgcgaagtggtctccagttgctacagcctggtacaggatgctccccgaggttgttcttctcaaagaaattaaaaatggtgatgcagaggagctagtgaaaagatgcccagttaatgtttttgacattgaagacctgggaaagggggagaagagagcagttgttgcaaagccaagatcatgcaccctttgtagggaatgtgtcagactggctgacgatcaagtagagctacggcgtgttagagaccacttcatttttacaatcgagtccaccggagctcttccgccagaggtgctcttcacagaggccgtgaagatccttgaggagaagtgcgagcgagtgatatccgaactttcctgagcctgatataaagttttcagtactgttctgatgtagtttttctattgctatgttgtgtcgaggacgaaagcttagtgtactaatataggttactgtgaaacttctgtatccaatattctggagtcacattcagctaatttattactgagctggtatatgcagcagtcctg

SEQ ID NO: 14324 - protein, 355 aa, Triticum aestivum
MENRDGSSLPDFLELQRTRVLCKADAPTHTEGFQYSGAFAAMGVDTSVSVEKFCKNFKIEINRLTDEDMEFDMIGVDASIANAFRRILIAEVPTMAIEKVFMVDNTSVIADEVLSHRLGLIPLDADPRLFDYISDDVPNERNTIVYKLHVSCEKGSQRLTVKSGQLEWLPEGSQLTMASPAQSGDNQRTYTSFGQSQQNTSERPLGVKYNDITIARLGPGQAIELEAHAVKGVGKVHAKWSPVATAWYRMLPEVVLLKEIKNGDAEELVKRCPVNVFDIEDLGKGEKRAVVAKPRSCTLCRECVRLADDQVELRRVRDHFIFTIESTGALPPEVLFTEAVKILEEKCERVISELS

SEQ ID NO: 14325 - DNA, 1294 bp, Triticum aestivum; identical to SEQ ID NO: 14323
  CDS (180)..(1124)

SEQ ID NO: 14326 - protein, 314 aa, Triticum aestivum
MGVDTSVSVEKFCKNFKIEINRLTDEDMEFDMIGVDASIANAFRRILIAEVPTMAIEKVFMVDNTSVIADEVLSHRLGLIPLDADPRLFDYISDDVPNERNTIVYKLHVSCEKGSQRLTVKSGQLEWLPEGSQLTMASPAQSGDNQRTYTSFGQSQQNTSERPLGVKYNDITIARLGPGQAIELEAHAVKGVGKVHAKWSPVATAWYRMLPEVVLLKEIKNGDAEELVKRCPVNVFDIEDLGKGEKRAVVAKPRSCTLCRECVRLADDQVELRRVRDHFIFTIESTGALPPEVLFTEAVKILEEKCERVISELS

SEQ ID NO: 14327 - DNA, 957 bp, Medicago truncatula
  CDS (1)..(957)
atggaaggcgcgtcatacgcacgcatgccgcgcgtcaaaatccgtgaactcaaagacgactacatgaagttcgagcttcgcgacactgacgccagcgtcgccaacgcgctacggcgcgtgatgatctccgaagtcccaaccgtcgccatcgaccttgttgaaatcgaagtgaactcttccgttctcaacgacgagttcattgctcacagactcggtctcattccactcacaagcgaacgtgccatggccatgcgcttctcacgtgactgtgatgcttgtgatggtgatggacagtgtgagtattgttcagttgagtttcatcttagggttaagtgtataacggatcagacgcttgatgttagtagtaaggatcttattagctccgatcataccgttacaccggtggatgttcctggtggtgatgcttctattgaatctgatggaagggggattatcattgtgaagttgaggagaggtcaggagctgaggttgagagcgattgctaggaaggggatcgggaaggatcatgccaaatggtcaccagctgcaactgttactttcatgtacgaaccagacattcacatcaatgaggatttgatggagtctttgacacttgaggagaaaaaggagtgggtggatagtagtccaactcgtgtctttgatattgatcctgttacacagcaggtgatggtagttgaccctgaggcatatagttatgatgacgaggtcatcaagaaagcagaagcaatgggaaagcctgggcttatagaaataactgcaaagcaagatagcttcattttcacggttgaatctaccggagcagtgaaagcatctcaattattgctaaattccattgaaattctcaagcaaaagctggatgctgtgaggctatctgaagacaccgtagaagctgatgatcagtttggtgagctgggtgcacatatgcgaggaggatga

SEQ ID NO: 14328 - protein, 318 aa, Medicago truncatula
MEGASYARMPRVKIRELKDDYMKFELRDTDASVANALRRVMISEVPTVAIDLVEIEVNSSVLNDEFIAHRLGLIPLTSERAMAMRFSRDCDACDGDGQCEYCSVEFHLRVKCITDQTLDVSSKDLISSDHTVTPVDVPGGDASIESDGRGIIIVKLRRGQELRLRAIARKGIGKDHAKWSPAATVTFMYEPDIHINEDLMESLTLEEKKEWVDSSPTRVFDIDPVTQQVMVVDPEAYSYDDEVIKKAEAMGKPGLIEITAKQDSFIFTVESTGAVKASQLLLNSIEILKQKLDAVRLSEDTVEADDQFGELGAHMRGG

SEQ ID NO: 14329 - DNA, 1140 bp, Oryza sativa (japonica cultivar-group)
  CDS (1)..(1140)
atgccgaagaaggggacgaaatcgaggaagggcacggacgatgagcccaagcaggaggagaagaacaagcttccggagcaccttgaggtccagcggacgcgtgtggtctgcaagggcgacgcccccgtaaatactgaaggttttcaatacgctggtgcttttgctgctatgggaatcgataacagtgtctcagcggataagttttgcaaaaactttaaagtcgtggtaaatcgacttacggaagatgatatggagtttgatatgattggtattgatgcatcaatggctaatgcttttcggagaatccttatagcagaggttcctacaatggcaattgagaaagttttaatggctgacaatacctcagttatagcagatgaagttctttcacatagacttggccttattccacttgatgcagatcctaggctttttgaatatatctcagaaaatgatgtcccaactgaaagaaacactattgtgtacaaactccatgtttcatgtaaaaagggttccccacggcttacagtgaagtctggtgatttagagtggctgccagaaggtagccaactacctttggcatctcctgctcaatctggggacaaacaaaagacgtacacttccttcagccaaagccagaaggatatcttagaaaagcctcttggtgtgaaatttaaagacataactattgcgaggcttgggccaggccaggctattgaacttgaggtacatgctgttaagggaataggaaaagtgcatgccaagtggtccccagttgctacagcttggtatagaatgctccctgaggttgttcttcgtgaagaaatcaaagatgctgatgcagagatgctagtggcaaagtgcccagtcaatgtttttgacatcgaagacctgggaaacggggaaaagagagcggttgttgctaggccaagagcatgcaccctttgtaggcaatgcgttatgggacctactggggaagttatgggacctactgtggaacaagtagaactacggcgtgtcagagaccacttcatctttacgattgagtctactggagctctaccgccggagatgctgttcacagaggctgtgaggatcctcgaggagaagtgcgagagagtgatatctgaactgtcatga

SEQ ID NO: 14330 - protein, 379 aa, Oryza sativa (japonica cultivar-group)
MPKKGTKSRKGTDDEPKQEEKNKLPEHLEVQRTRVVCKGDAPVNTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTVKSGDLEWLPEGSQLPLASPAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTVEQVELRRVRDHFIFTIESTGALPPEMLFTEAVRILEEKCERVISELS

SEQ ID NO: 14331 - DNA, 1158 bp, Arabidopsis thaliana
  CDS (1)..(1158)
atggggactaacgaagtaacaaggattgtgactgatgaagaaaagagagaagcgaagaacttcaacatatttgatctccctgacgttcctaccggacttcctccgcatcttgagctccagcgaactcgcgttgtctgtaagaaggattctaatattcatcctacggctatcactttctcgggtgcctattcctctatgggagtggacaacagtgtgagactagaaaacttctctgaggatttcaaagttgatgtgattagtctcacagagacagatatggtattcgatatgatcggtgtccatgcaggaatcgctaatgctttccgaagaatcctcttagctgagcttccttcaatggctattgaaaaagtgtatgtagcaaacaacacatcggttattcaagacgaagttcttgctcacaggttgggtcttattccaattgccgcagatccgagactctttgaatatttatctgaaaacgatcagccaaatgaaaagaacaccattgttttcaaactccatgtgaaatgtctaaaaggtgacccgcgtcgtaaagtcttaacaagcgaattgaaatggttaccaaatggaagtgagcttatcaaagaatctggaggttcaaccacaacgccaaaaacttacacttcattcaaccatagccaagattccttccctgaatttgctgaaaatcctatcaggccaaccttaaaagatatcttgatagcaaaacttggccctggccaggaaatcgagcttgaggctcatgccgttaagggcattggtaaaacacatgcaaagtggtccccagtagcaacggcttggtatcgaatgcttcctgaggtggttctactaaaggaattcgagggtaaacatgccgaagaactcgtaaaagtctgccccaagaaagtttttgacattgaagacatgggccaaggtaggaagagggcaacagtagctcggccgcgtgattgttcgttgtgtagagaatgcataagagatggagtggaatgggaggaccaagtggatctgcgccgtgtcaagaaccattttatatttacaattgagtccacgggatcacagcctccggaggttcttttcaacgaagcagtgaagatattggaagataaatgtgaaagagtaatctctgaactctcctga

SEQ ID NO: 14332 - protein, 385 aa, Arabidopsis thaliana
MGTNEVTRIVTDEEKREAKNFNIFDLPDVPTGLPPHLELQRTRVVCKKDSNIHPTAITFSGAYSSMGVDNSVRLENFSEDFKVDVISLTETDMVFDMIGVHAGIANAFRRILLAELPSMAIEKVYVANNTSVIQDEVLAHRLGLIPIAADPRLFEYLSENDQPNEKNTIVFKLHVKCLKGDPRRKVLTSELKWLPNGSELIKESGGSTTTPKTYTSFNHSQDSFPEFAENPIRPTLKDILIAKLGPGQEIELEAHAVKGIGKTHAKWSPVATAWYRMLPEVVLLKEFEGKHAEELVKVCPKKVFDIEDMGQGRKRATVARPRDCSLCRECIRDGVEWEDQVDLRRVKNHFIFTIESTGSQPPEVLFNEAVKILEDKCERVISELS

SEQ ID NO: 14333 - DNA, 1128 bp, Arabidopsis thaliana
  CDS (1)..(1128)
atggtgactaaagcagaaaaacaattcgccaaaaatttcaacatagacgatctccctgacgtccctgccggacttcctccacatctcaaagcccagcaaactcgtgtcgtctctaaaaacaacgctcctgctcatactgcgagtgccatttactcgggtacctatgtttcttctacggaagaggacgacaatgtgaagctaggaaacttctatgataacttcaaagttgatgtggttagtctcacaaagacagatatggaatttgatatgattggtattgatgcagcgtttgccaatgcattccgaaggatccttatagctgaggttccttcaatggctattgaaaaagtgttgatagcgtacaacacatcggttattatagacgaagttcttgctcacaggatgggtcttattccaattgccgcagatccaagactttttgaatatttatccgaacatgatcaggcgaatgaaaagaacaccattgtattcaaactccatgtgaaatgtccgaaaaatagaccacgtcttaaagttttaacgagtgatttaaaatggttaccaaatggaagtgagcttctgagagaatcggaaaataaaacctcaaagccaaaaacttacacttcattcagttgcagccaagattcattacctgaatttgctaataatcctatcactccatgcgacctcgatatcttgatagcaaaactcgcccctggtcaggaaatcgagctcgaagctcatgcggttaagggcattggtaaaacacatgcaaagtggtctccagtagggactgcttggtatagaatgcatcctgaggtggttctacgtggggaagttgaggatgaacttgctgaacgacttgtaaacgtctgcccacagaatgttttcgacattgaagacatgggaaaaggtaagaaaagggcaacagtagcgcagccacgtaagtgcacattgtgtaaggaatgcgtaagagacgatgatttggtagaccatgtggatcttggcagtgttaagaaccattttatatttaacattgagtccaccggatcactgcctccagaggttctcttcactgaagctgtgaagatattggaagctaaatgtgaagctataaccgacttttga

SEQ ID NO: 14334 - protein, 375 aa, Arabidopsis thaliana
MVTKAEKQFAKNFNIDDLPDVPAGLPPHLKAQQTRVVSKNNAPAHTASAIYSGTYVSSTEEDDNVKLGNFYDNFKVDVVSLTKTDMEFDMIGIDAAFANAFRRILIAEVPSMAIEKVLIAYNTSVIIDEVLAHRMGLIPIAADPRLFEYLSEHDQANEKNTIVFKLHVKCPKNRPRLKVLTSDLKWLPNGSELLRESENKTSKPKTYTSFSCSQDSLPEFANNPITPCDLDILIAKLAPGQEIELEAHAVKGIGKTHAKWSPVGTAWYRMHPEVVLRGEVEDELAERLVNVCPQNVFDIEDMGKGKKRATVAQPRKCTLCKECVRDDDLVDHVDLGSVKNHFIFNIESTGSLPPEVLFTEAVKILEAKCEAITDF

SEQ ID NO: 14335 - DNA, 1122 bp, Magnaporthe grisea 70-15
  CDS (1)..(1122)
atgccttcacaaacaagtctgagctctgaagagctgaacaggcgaaagcttgttggtatcaacaaggagacagttacaaatacgatatcgactgattatcctggcgcacactatggcgaggagcacgcctgggacgtgaacgagttttcccagcatctcaacatacaattccaccagaatgaccccagcctagcgtcattcagtctaatcggcgtcgacgcctccatcgcaaatgccttccgccgtatcatgatcgccgagatcccctccctcgccatcgagcgagttttcataaccaacaacacctctgtaatacaggatgaggtgctcgcccaacgcctgggtctcgtcccactcaagggatccaaggagggcctgcgcaagttcatgaagcccttcaagaggaccgagacgggcggcttcgacaactcgttcgacttcaacacagtgaacctccggctcaacgtcaagtgcacccggaaccccgacgcgaagccgggtgagaatgacccgaacaaggcctacatcaagcccaacgtctacgccagcgacatcgagttcgtgcccgccggccagcagaccgactacttttcgggcgacggcgccatagtgcccgtgaacccggacatcctgatcgccaagctgcggccgggccagggcatcgacctcgagatgcacgcccacatcggctacggctgggaccacgcaaagttctcgcccgtctgcactgcctcgtatcgcctcatgcccatcatcgacatcgtcaagcccatcgtcggcgccgacgccgaaaagttccgcgactgcttccccgacggcgtcatcaggctgcagcccgtcaccgccgccgaggccaaggagaagggcagcggctacgagggccacaagggcgagatgaaggccgtcgtcaacgaccccatgcgcgacaccgtcagtagggagtgcctgcgacatgccgagttcgagggcaaggtcaagttgggccgcaggcgggaccatttcattttctcgattgagagcgccgggcagtgggatagtgatgagctcttcctggcttccatcgcggagctcaagtccaagtgcaagaagctagaggagcaggttcttaacatggttaggtga

SEQ ID NO: 14336 - protein, 373 aa, Magnaporthe grisea 70-15
MPSQTSLSSEELNRRKLVGINKETVTNTISTDYPGAHYGEEHAWDVNEFSQHLNIQFHQNDPSLASFSLIGVDASIANAFRRIMIAEIPSLAIERVFITNNTSVIQDEVLAQRLGLVPLKGSKEGLRKFMKPFKRTETGGFDNSFDFNTVNLRLNVKCTRNPDAKPGENDPNKAYIKPNVYASDIEFVPAGQQTDYFSGDGAIVPVNPDILIAKLRPGQGIDLEMHAHIGYGWDHAKFSPVCTASYRLMPIIDIVKPIVGADAEKFRDCFPDGVIRLQPVTAAEAKEKGSGYEGHKGEMKAVVNDPMRDTVSRECLRHAEFEGKVKLGRRRDHFIFSIESAGQWDSDELFLASIAELKSKCKKLEEQVLNMVR

SEQ ID NO: 14337 - DNA, 1146 bp, Gibberella zeae PH-1
  CDS (1)..(1146)
atggctcccacacagcaggctgcgtggagaaacgctcccaccgcagaggatcttgcgcgccgtcagactgttggcatcaacaaggaaactgtcacaaacatttcctccaccgattatcccggacaccaccccggcgaggataatgagtacactcttgatcgcttccgcgacgccttctcggtgaactttcaccagaacgaccagtttctctcctctttctcacttgtcgggatcgacgcctcgctcgcaaacgctttccgccgtatcctcctctccgagattcctaccctcgccgtcgagaacgtctacatcgagaacaacacctccgttattcaggacgaggttctcgcccaccgacttggccttattcccttcaagggtggtcgcgagggtctgcacaacttcctcaagtggcacaagaagccagaggctggtgacgatccttatgcaggctgcttcgactggaacacggtccgcctcgagcttaatgtgacatgtaccgtcaacgaggacgcttcgcctaccgagaacgaccctctcaaggcgtaccacaatgcccacgtttatgcgcgagacattgtctttgtgcccactggcagacaggccgaatactttagcggcgagaacgctattgcgcccacgaaccctgatatcttgattgccaagctacgaccccgacagaccatcaaccttgctatgcacatgcacaagggtattggatccgaccacgccaagttctcccccgtcgcaacagcctcttaccgtctcctaccaaccattacgatcacccagcccatcctgggagccgacgccgagaagtttgccaagtgtttccccaagggtgttattgggcttgagaaggttacagccgaggatgccgcaaagaccggcagtggttatgagggacacaagggcgagaccaaggcggtggtcgtcgacgccatgaaggatactgtcagccgtgaggctctccgtcatgaagagttccaaggcaaggtgaagcttggccgaagacgagaccactttatcttctccatcgagagcacggggcagtgggacagcgatgagctcttcctcgagtcagttaagcatctaaagcttaagtgtaagaagctcgagcagcaagttatcaacatggcgcggtaa

SEQ ID NO: 14338 - protein, 381 aa, Gibberella zeae PH-1
MAPTQQAAWRNAPTAEDLARRQTVGINKETVTNISSTDYPGHHPGEDNEYTLDRFRDAFSVNFHQNDQFLSSFSLVGIDASLANAFRRILLSEIPTLAVENVYIENNTSVIQDEVLAHRLGLIPFKGGREGLHNFLKWHKKPEAGDDPYAGCFDWNTVRLELNVTCTVNEDASPTENDPLKAYHNAHVYARDIVFVPTGRQAEYFSGENAIAPTNPDILIAKLRPRQTINLAMHMHKGIGSDHAKFSPVATASYRLLPTITITQPILGADAEKFAKCFPKGVIGLEKVTAEDAAKTGSGYEGHKGETKAVVVDAMKDTVSREALRHEEFQGKVKLGRRRDHFIFSIESTGQWDSDELFLESVKHLKLKCKKLEQQVINMAR

SEQ ID NO: 14339 - DNA, 1005 bp, Candida glabrata CBS 138
  CDS (1)..(1005)
atgtctaatatagttggtattgagtataaccgtgtgacgaacactgcgtctaccgatttccctgggtactcttctcaaggtgccaatgcttgggatgtggagaggtttagagagacgtttgatatccaggtctctagccatgaagagagggagttgaacttcgatatgattggtattgacacgtctttggccaatgcgttccgtcgtattatgattgctgaggttccagctgtggccccagagtacgtttacattcagaacaacacctctgtgatacaggatgaagtgttggctcacagaattggtcttgtgccattgaaggtggacccagagaagctggagagattggacacttctgacccagacaacttagaattccatgacaagaacaccattgttatgaccttgaatgtcaagtgtaccagaaacccagatgcaccaaaggactgcactgatccaacgatcctgtacaacaatgcgcatgtctacgcccgtgacttgaaatttgagcctcacagtagccaagtggaaaccttcgccgattgtccagtggtcccatgtgacccagatatcttattggctaaactaagacctggtcaagaaatcagtttgagcacacattgtatactgggtgaaggtaaggaccacgccaaattctccccagttgccactgcttcttatagattgctacctcacatcgaaattctagagcccattactggcgattccgccaagagattccaagcctgtttccctaaaggtgtgattggcatcaacgagaatggtgaagcatacgtgctggacccaagaaaggatacagtttccagagaagtgctaagacatgaagaatttgaaggtaaagtaaaactaggtagagtcagagaccattttgtctttaacgttgagagcacaggtgccatgcaaccagaagatatagtgctgaagtccattgatatcctgaagaagaaggccgagtatttgaagaaatgtcaaattacccaataa

SEQ ID NO: 14340 - protein, 334 aa, Candida glabrata CBS 138
MSNIVGIEYNRVTNTASTDFPGYSSQGANAWDVERFRETFDIQVSSHEERELNFDMIGIDTSLANAFRRIMIAEVPAVAPEYVYIQNNTSVIQDEVLAHRIGLVPLKVDPEKLERLDTSDPDNLEFHDKNTIVMTLNVKCTRNPDAPKDCTDPTILYNNAHVYARDLKFEPHSSQVETFADCPVVPCDPDILLAKLRPGQEISLSTHCILGEGKDHAKFSPVATASYRLLPHIEILEPITGDSAKRFQACFPKGVIGINENGEAYVLDPRKDTVSREVLRHEEFEGKVKLGRVRDHFVFNVESTGAMQPEDIVLKSIDILKKKAEYLKKCQITQ

SEQ ID NO: 14341 - DNA, 1005 bp, Kluyveromyces lactis NRRL Y-1140
  CDS (1)..(1005)
atgtccaatatcgttggtgttgaatataaccgtgtgacgaacacaagttcaacagatttccctggatttagttcggatcaagacaattcatgggacttggagaagttcaaggaaacttttgacgtacaaatcgagagtttggatgagcgtgaagtgaatttcgatttggttcatgtcgacacatcgattgctaacgctttccgtcgtattatgatctcagaagtaccatctgtcgctccagaatacgtctacttttttaacaatacgtctgtgctacaggacgaagtgttggcgcatagaatcgggttagtgccattgaaggtggatccagatatgttgagttgggtggacacgtcattgcccgaatctgaaaggtttacagatgaaaatacgatagtgatgtcgttgaacgtgaaatgtaccaggaacccagatgctccaaaggattgtgaagaccccaaggttctttatagaaacgcgcatatctatgctagggaccttaagtttgagcctcaggggaaacaggtggaacaatttgccaagtgtcccgtggtggcagcggatccagatatcttgttggccaagttgagaccaggtcaagagatttcgttaagggcacattgtattctaggtatcggtgcagaccatgccaagttctctccggtgtcgacagctagttatagactattaccacacatccagatcacacagcctatcaccggtgatgatgccaagaaatttgtgaaatgtttccctaaaggtgtcgcagatgtcaacgagaagggtgaagcttatatcaaggatccaaggaaggataccgtgtccagagaggtgttgagacacgatgagttccaggggaaggttaagttgggtagggtgagagaccacttcatctttaacgtggagagttctggtgctatgacaccggaagaaatcttcttcaaatcggtcaggatcttgaagaacaaggcggaatacttgaagaactgtccaatctcacaataa

SEQ ID NO: 14342 - protein, 334 aa, Kluyveromyces lactis NRRL Y-1140
MSNIVGVEYNRVTNTSSTDFPGFSSDQDNSWDLEKFKETFDVQIESLDEREVNFDLVHVDTSIANAFRRIMISEVPSVAPEYVYFFNNTSVLQDEVLAHRIGLVPLKVDPDMLSWVDTSLPESERFTDENTIVMSLNVKCTRNPDAPKDCEDPKVLYRNAHIYARDLKFEPQGKQVEQFAKCPVVAADPDILLAKLRPGQEISLRAHCILGIGADHAKFSPVSTASYRLLPHIQITQPITGDDAKKFVKCFPKGVADVNEKGEAYIKDPRKDTVSREVLRHDEFQGKVKLGRVRDHFIFNVESSGAMTPEEIFFKSVRILKNKAEYLKNCPISQ

SEQ ID NO: 14343 - DNA, 1008 bp, Debaryomyces hansenii CBS767
  CDS (1)..(1008)
atgtctgataatattgttggtattgaatataacagggttaccaatacgtcctctactgattttccaggtcacagctccaatggtgactttgcttgggatatagaaaagtttaaagattcgttcgagattaacatttcacatctctctgaaagatcgtcaacttttgacttaatccacatagatacttcaattgcaaatgcttttcgtcgtattatgatttcagaagtaccttctgttgctgctgaaacggtttatgttttcaacaatacgtcagtcatccaagatgaagtattagcacacagaattggattaattccattaaaggtagacccagacactcttacttggattgacacagctcaggatgagaaagaccgttttaccgatgagaatactattgttatgtcgttagatgtcagttgtaccaagaacccacatccacctcaaggttctactgatccaaaagagttatacagaaattcccacgtttatgccaaagacttgaagtttgaaccacaaggtcgtcaacttgagattttcaagaataatcctgttgttgcagctgacccggatattttgttggccaagttaagaccaaatcaagaaatttccttaagggctcattgtatattaggtgttggaagtgatcatgctaaattctcaccagtagctactgcatcatacagattgatgccagttattaccataactgaaccaatcaagggcgaatccggaaagcgtttccaaaagtgtttcccatcaggggtcattgatatcaacaagaacggtgaggccgttgtcaaggactcaagaaaagacacggtatcaagagaagtcttaagacacgaagagttcaatggtaaggtcaaattaggtagaaagagagatcatttcattttcaatgttgaatctaccggtgccatgtcaccagaagaaatcttcttcaagtcggttagagtattaaagaacaaggctgaatacttaagaaattgtccaattggccaatag

SEQ ID NO: 14344 - protein, 335 aa, Debaryomyces hansenii CBS767
MSDNIVGIEYNRVTNTSSTDFPGHSSNGDFAWDIEKFKDSFEINISHLSERSSTFDLIHIDTSIANAFRRIMISEVPSVAAETVYVFNNTSVIQDEVLAHRIGLIPLKVDPDTLTWIDTAQDEKDRFTDENTIVMSLDVSCTKNPHPPQGSTDPKELYRNSHVYAKDLKFEPQGRQLEIFKNNPVVAADPDILLAKLRPNQEISLRAHCILGVGSDHAKFSPVATASYRLMPVITITEPIKGESGKRFQKCFPSGVIDINKNGEAVVKDSRKDTVSREVLRHEEFNGKVKLGRKRDHFIFNVESTGAMSPEEIFFKSVRVLKNKAEYLRNCPIGQ

SEQ ID NO: 14345 - DNA, 1020 bp, Yarrowia lipolytica CLIB122
  CDS (1)..(1020)
atgaccagccttgctaaccgcaacattgtcggcatcgagtccgatcgagtgacaaacgtgacttccacggacttccctggccactggcctggggccgacgacgcctgggacctcgacaagttcgacaagaacctgcaggtgaagatccattccctgaccgacaattacagcaactttgacctgattggcatcgacacgtcgctggccaacgcctttcgacgaatcatgatcgcagatatccccaccattgccgtcgaagaggttttcatccacgcaaacacctccattatccaggacgaggtgctggcccaccggctgggtctggtgcctctggtgatcaaccccgagcgaatcaacgccctgcctcgaggtctggacgcttccgagatcgaggactactacgacgactccaacacctttgtgctgcggctcaatgtcacctgtgagcgactggccgacggcaccatgaagaacgcccacatctacgcacgagacatcacctttgatcccatgggcaaccagtgccagtgggtcaaggacgaggggctggagaacgtgttcaaggtcgccaaccccgacattctgatcgccaagctgcgacccaaccagagcatcaacctgaccatgttctgccatctgggtttcggacatgaccacgcaaagttttctcccgtggccaccgcctcctacagactcatgcccaccatcaccatcaccggtgacattaccggtgacgaggccaagaagttccaaaagtgtttccccaagggcgtcattgagctggagggaggcaagcccgtggtggccgacgccagaaaggacacagtgtcgcgagaagtgctgagacacgaggagttcaacggcaaggtcaagctcggccgacgacgagaccatttcattttcaacgtcgagtcttccggagctctggagcccgacgagatctttctcaagagcgtcatggagctgcaggccaaggcccagacgttgaaggctgctgtgagtggatacatgcagcagtaa

SEQ ID NO: 14346 - protein, 339 aa, Yarrowia lipolytica CLIB122
MTSLANRNIVGIESDRVTNVTSTDFPGHWPGADDAWDLDKFDKNLQVKIHSLTDNYSNFDLIGIDTSLANAFRRIMIADIPTIAVEEVFIHANTSIIQDEVLAHRLGLVPLVINPERINALPRGLDASEIEDYYDDSNTFVLRLNVTCERLADGTMKNAHIYARDITFDPMGNQCQWVKDEGLENVFKVANPDILIAKLRPNQSINLTMFCHLGFGHDHAKFSPVATASYRLMPTITITGDITGDEAKKFQKCFPKGVIELEGGKPVVADARKDTVSREVLRHEEFNGKVKLGRRRDHFIFNVESSGALEPDEIFLKSVMELQAKAQTLKAAVSGYMQQ

SEQ ID NO: 14347 - DNA, 1122 bp, Aspergillus nidulans FGSC A4
  CDS (1)..(1122)
atggctcccctagtcccgtcgcatgaagagcttgaacgcagacgtattgtcaacgttaacgcagagacggtcactaacatcgcttctactgatttccccggccactggccaggcgagtcgcacgaatggaatcttgataaattcagagatggcttccgggtcgacttccaccaaaacaagaagttcgaggcttctttttccttgatcggtttggatgcctctatcgcaaacgcattccgtcgcattgtcatggctgaagtgcctactctcgctattgaatgggtatacattcacaataacacctctgtcattcaagatgaggtgcttgcacagcggcttggtcttatccctcttcagggttcagtcgaaggcctcaactggatgcagtggtacaacaagggcagcgaagatgagcctggcagcggtagcgacctggcagattacaacaccgtcgttctgcgtctcgacgtcgaatgtaccaagaacccgaatgcatcccgtgacgaaacagaccctcgcaaactgtacaagaacgcacacgtctacgccaaggatatcgttttccaccctgtcggccgccaagaagagttcttcaccggtgaaggcgccattcgagctgtgaaccccgatattctcgttgctaagcttcgccctgggcagaagatagagttggaaatgcactgtattaaaggcattggagcagatcatgccaaattctccccggtagcgacagcgacttatcgtctgatgccggtcatccagattttgcgccctatcattggagaggacgcgaagaaattcgccaaatgcttccctaagggagttattggtcttgagcccatcaccgctgaggatgagcggcaaaacgctgaatatcgtggtcgtggcggcgagcttaaggccgttgttcgcgatgctttcaatgataccgttagcagggagtgcttacgacatgatgaattcaaaggcaaggtcaagttgggccggattcgcgatcacttcatcttcaacattgaaagcactggacagtttgacagcgacgttctcttcctcgaaagcgtgaaggtgctgaagctcaaatgtgcacggtggaagcggggcttgacggacctcatgcgatag

SEQ ID NO: 14348 - protein, 373 aa, Aspergillus nidulans FGSC A4
MAPLVPSHEELERRRIVNVNAETVTNIASTDFPGHWPGESHEWNLDKFRDGFRVDFHQNKKFEASFSLIGLDASIANAFRRIVMAEVPTLAIEWVYIHNNTSVIQDEVLAQRLGLIPLQGSVEGLNWMQWYNKGSEDEPGSGSDLADYNTVVLRLDVECTKNPNASRDETDPRKLYKNAHVYAKDIVFHPVGRQEEFFTGEGAIRAVNPDILVAKLRPGQKIELEMHCIKGIGADHAKFSPVATATYRLMPVIQILRPIIGEDAKKFAKCFPKGVIGLEPITAEDERQNAEYRGRGGELKAVVRDAFNDTVSRECLRHDEFKGKVKLGRIRDHFIFNIESTGQFDSDVLFLESVKVLKLKCARWKRGLTDLMR

SEQ ID NO: 14349 - DNA, 1110 bp, Candida albicans SC5314
  CDS (1)..(1110): transl_table=12
atgtattacattaccattcgtcatcaatactctcttctttttttttcaagtattagacatatcatcgataaaataccaataaaaaaaggcaatagtataatgtcagataataacattgttgggatagaatataatagagtgacaaacactacttcaactgatttcccaggtcatcaacaaaatggagattattcatgggacattgaaaaatttaaaaacaagtttgaaatcaaaatcacaaatttgagtgaaaggacggggacttttgatttgatacatattgatacatcaatagctaatgcatttcgtcgtattatgattgccgaagttccttcagttgctgctgaaactgtatatatgtttatgaacacttcagttattcaagatgaagtattggcacaaagaattgggttaatcccatggaaaatcgaccccgataagttgacttgggtagatgaaactgttgatatcaatgatcgtttcacagaagataatacaattgtgttatcattagatgttgcatgttcgaaaaaccctcatgcacctaaaaattctactgatcctagagaattatataaaaattctcatgtttatgctaaagatttcaaatttgaacctcatgggaatcaagaagaaaaatttaaagatactccagtggtgccttgtgatcccgatattttattggctaaattaagaccaggtcaagaaatttcattaagagctcattgtgtattgggtattggatctgatcatgctaaattttctcctgtggctactgcatcttatagattattgccagttatagatattaaagaaccaattacgggggaattggctaaaaaattccaaaaatgtttcccaccaggagttattggtatcgatgctaatggtaaagcatacgttaaagatgccagaaaagatactgtttctcgtgaagtattaagacatccagaatttgatggtaaagtccaattaggtagacaaagagatcatttcatattcaatgttgaaagtaccggggctatgcctccagcagagattttcttcaaatcagtaagattattgaaaaataaagctgaatatttgagaaattgtccaattggtcaataa

SEQ ID NO: 14350 - protein, 369 aa, Candida albicans SC5314
MYYITIRHQYSLLFFSSIRHIIDKIPIKKGNSIMSDNNIVGIEYNRVTNTTSTDFPGHQQNGDYSWDIEKFKNKFEIKITNLSERTGTFDLIHIDTSIANAFRRIMIAEVPSVAAETVYMFMNTSVIQDEVLAQRIGLIPWKIDPDKLTWVDETVDINDRFTEDNTIVLSLDVACSKNPHAPKNSTDPRELYKNSHVYAKDFKFEPHGNQEEKFKDTPVVPCDPDILLAKLRPGQEISLRAHCVLGIGSDHAKFSPVATASYRLLPVIDIKEPITGELAKKFQKCFPPGVIGIDANGKAYVKDARKDTVSREVLRHPEFDGKVQLGRQRDHFIFNVESTGAMPPAEIFFKSVRLLKNKAEYLRNCPIGQ

SEQ ID NO: 14351 - DNA, 918 bp, Encephalitozoon cuniculi GB-M1
  CDS (1)..(918)
atgtcgaagatacacaagctgggaagagagatgatgactgacctgtattgtgcagaggcaaagtcatttgagcagactgtggatgagatagagataaggataacagagtacagctcggagaagttagagtttgacctgatcaatgtcgactgctccattgccaatgctctgaggcgcatactctcgagcgaggttcccacgatggcagtgcgggacatttttctgaaggaaaacgagagcgtgttcccggacgagtttatagcacacaggctggggctggtccccttggaggtagacccggagatgttcgagtttgcgggcgaagaattggacgaaaggaactctcttaggtttactcttgatgttaggaacgagtctgaaggtgttctgaatgtatattcggatgacatcagatggaatccagtggggagccagagggagattttcagggatgtcaagttcagcagcagggtgcttatgtttaggctagctcgtggacaaaagataagtgcagagcttgtgtgcaccaagaatgtggggaaggtgcatgcgaagtggagtccggtgtgtccagcaacctacaggctcatgccattgattgagataggagacatctttgatgaggatgcctacaagctgcagaaatgtttttcggagggagtcatagatgtaaggcccagcgacgggagaatgaaggcctatgtgagtaatcctcggctggattcgatgagcagagaggcgcttagacatgaggagttcaaggacaagatatttattggaaggaggtctgactacttcctatttacaatcaacaccgtgtttctggatccgctttacctgctagagaaggcggtttcagtacttatagaaaaaagcagagccttgaggtgcgaggctgagggtcttctgggacaatga

SEQ ID NO: 14352 - protein, 305 aa, Encephalitozoon cuniculi GB-M1
MSKIHKLGREMMTDLYCAEAKSFEQTVDEIEIRITEYSSEKLEFDLINVDCSIANALRRILSSEVPTMAVRDIFLKENESVFPDEFIAHRLGLVPLEVDPEMFEFAGEELDERNSLRFTLDVRNESEGVLNVYSDDIRWNPVGSQREIFRDVKFSSRVLMFRLARGQKISAELVCTKNVGKVHAKWSPVCPATYRLMPLIEIGDIFDEDAYKLQKCFSEGVIDVRPSDGRMKAYVSNPRLDSMSREALRHEEFKDKIFIGRRSDYFLFTINTVFLDPLYLLEKAVSVLIEKSRALRCEAEGLLGQ

SEQ ID NO: 14353 - DNA, 1149 bp, Ostreococcus tauri
  CDS (1)..(1149)
atgggacggcccaccggcgccggcggcggcgacgacgcggacgagatcaccgagcaaatggcgaagatgctggcgaagatcgaggaacagaagaaatacctcatcgctggcgcggatcgaaacgcgaacgcgaaggagatcgcgtacggtggggcgtacgcgtcgatggagggcgagggggcgttttcggttgacgcgtttcgagagacgttcgcgctgacgatcacggacgcgagtgaggagcgggtggtgttcgagatggagggatgctcggcggcgtttgcgaatgcgtttcgtcgaatcataatctcggaggtgccgacgatggcgatcgagaaggtttacatgattaacaacacgagcgtggtgccggacgaggttttcgcgcaccggctcggtttggttccgatcaaggcggatccggcgcggtttgaatacagaggcccgaacgatttggcaaatgagacgaacacgatcgttttgagccttcacgcgaggtgtcaccgcgagcgtttggacgacgggtctctcggcgaggtggtcaaccgaagcgtgtactcgaacgcgctgcagtggtgtccggacggaagccaactgcctgaggaagagagggcgaagtactccgactttaagcgctcgcaacgcgagagtttcggcgaagaggagcttgggtgcgtgcacgacgacattttgctcgtcaaactagcaccaggtcaagagattgagctcgagtgtcactgcgtcaagggcatcggtcaggagcactcaaagtggtcgccagtggggacgtgttggtacagaatggtcccggagattacgattttagaaccaatcacgggagccgacgcggatgtgttcatggagaggtgcgcaaacttcaacgacacgcacgcgtgctacgcgtgcgagggcaagggtgataagaagacggtgaaggttgtcgaaacgcgcgggtgcgatttgtgcgtcgagagggtgcgagagctcacgggcgagccgggatgggatgagaagatcgccgttcgaaaacacaagaatcacttcatcttcaccatcgaatccgtcggtcagatgaaacctggcacaattttcaaggaggctgtgaaaattttagcgtcgaaatgtcagaacgttttaagtacgctgtga

SEQ ID NO: 14354 - protein, 382 aa, Ostreococcus tauri
MGRPTGAGGGDDADEITEQMAKMLAKIEEQKKYLIAGADRNANAKEIAYGGAYASMEGEGAFSVDAFRETFALTITDASEERVVFEMEGCSAAFANAFRRIIISEVPTMAIEKVYMINNTSVVPDEVFAHRLGLVPIKADPARFEYRGPNDLANETNTIVLSLHARCHRERLDDGSLGEVVNRSVYSNALQWCPDGSQLPEEERAKYSDFKRSQRESFGEEELGCVHDDILLVKLAPGQEIELECHCVKGIGQEHSKWSPVGTCWYRMVPEITILEPITGADADVFMERCANFNDTHACYACEGKGDKKTVKVVETRGCDLCVERVRELTGEPGWDEKIAVRKHKNHFIFTIESVGQMKPGTIFKEAVKILASKCQNVLSTL

SEQ ID NO: 14355 - DNA, 1200 bp, Medicago truncatula
  CDS (1)..(1200)
atgtcgtcgtctggagatgaatcaatggcatcggagattgatgaacaagaacaaaatggaggaagaggaatacccgattacatcatgaacttagaagacgttccttcaacgcttcccactcatcttgaacttcaaaaaactcgcgttttttgcaatctcgatgctcctcaacatacagatacaatacaatattctggtgcttatgcagcattaggagttgataacagtgtacggttggataatttctatcaaaatttcaaggttgaagtgaaacgcatcacggatgaagaaatggagtttgacatgattggtattgatccagcagttgccaatgcttttcgacgaattctcatagcagaggttccaaccatggctattgaaagagtatacatagcaaacaatacatcacttgtacaagacgaagttctttcccatagactgggtctcattcctatcgatgctgatcccaagctatttgaatatccagatgatgccggaggtgaaaacaatgaaaagaacaccattgtgttcaaacaacatgttcgttgtgaaaagggtcaacctcgtcttaccgtgaaatcagatacactgaagtggttgcctaacgggagtgagcttattgctgaaggtaccaaatcagctgccgatccagcaccaaaaacatttacgacttttaatcaaaagtcacttcctaaattctccaaagatccagctccttataatttggatgttatagtagctaaacttggacctggtcaggaaatcgaacttgaagctcacgctgtcaaaggcattggtaagacacatgcgaaatggtctccggttgctactgcttggtatcgaatgcttcccgaggttgtgctcacgaaagatgttaaggatgagttggccgaagaactagtaagcaaatgtccagctaaagtatttgatatagaagatattggaagaggtagaaaaaaggctgtggtaaaaaacgcgcgagcatgcactctgtgtagggaatgcataagagaagcggatgaaggcgaagaaggaggagaaggggaaaaatggactgatcgtgtatcacttcgtcgtgtcaaagatcatttcatttttactattgaatcaactggagcaataccaccggatgtgctatttactgaagctgtgaagattctggaagataagtgcgaacgagtgattacggagctttcttga

SEQ ID NO: 14356 - protein, 399 aa, Medicago truncatula
MSSSGDESMASEIDEQEQNGGRGIPDYIMNLEDVPSTLPTHLELQKTRVFCNLDAPQHTDTIQYSGAYAALGVDNSVRLDNFYQNFKVEVKRITDEEMEFDMIGIDPAVANAFRRILIAEVPTMAIERVYIANNTSLVQDEVLSHRLGLIPIDADPKLFEYPDDAGGENNEKNTIVFKQHVRCEKGQPRLTVKSDTLKWLPNGSELIAEGTKSAADPAPKTFTTFNQKSLPKFSKDPAPYNLDVIVAKLGPGQEIELEAHAVKGIGKTHAKWSPVATAWYRMLPEVVLTKDVKDELAEELVSKCPAKVFDIEDIGRGRKKAVVKNARACTLCRECIREADEGEEGGEGEKWTDRVSLRRVKDHFIFTIESTGAIPPDVLFTEAVKILEDKCERVITELS

SEQ ID NO: 14357 - DNA, 1122 bp, Aspergillus oryzae
  CDS (1)..(1122)
atggcgcctctcgttccttcgcaggcggagcttgatcgccggaggctcgtcgacatcaatctggaaacggtctccaacatcccctccacagatttcccgggtcactggccaggcgagtcgcatgagtggaacctggagaaatttagaaatgagttcaatgttgagttccatcgcaatgaaagattcgaatcttctttctctctcatcggcgtcgatgcatcgatcgcaaatgccttccgtcgtatcgtaatggctgaagtgcctagcgttgccatcgagttcgtcttcgttcacaataacacctccgtcatccaggatgaagtgctcgcccagcgactgggtctgattccactgaagggttccgtggatggtattaactggatgcgttggttcaagaaggccacggaggatgatcccgagggtagcgatccatccgattacaacaccatcgtcttgcgactggatattgaatgtaccaagaaccccaacgctgacgccacggagaatgacccccgcaagctgtataagaatgcgcatgtttacgccagagacatcactttccaccctgtcggacgtcaggagcaattcttcactggcgaggatgctatccagccggtcaacccagacattttgatcgctaagcttcgcccgggccagaagatcgaccttgaaatgcactgtatcaagggtattggagccgaccatgctaagttctcgcctgttgctaccgcatcataccgtttgcttcccgatatccagattctgcgccccattcttggagaagacgccaagaagttcgccaagtgtttccctaagggcgtgattggtttggagcctgttacccgggaagaggccgcaaaacaggggagcggatacgagggccacgagggggagacgaaggccgttgttcgcgatgccttcaaggataccgttagcagggaatgtctcagacatgaggagttccaaggaaaggtgaagctcggtcgcgtgcgcgaccatttcatcttcaacatcgaaagcactggccaattcgatagtgatgtccttttcttagaaagcgtgaaggtcctgaagctcaaatgcgccagatggaagcggggattggcggatctcatgcggtaa

SEQ ID NO: 14358 - protein, 373 aa, Aspergillus oryzae
MAPLVPSQAELDRRRLVDINLETVSNIPSTDFPGHWPGESHEWNLEKFRNEFNVEFHRNERFESSFSLIGVDASIANAFRRIVMAEVPSVAIEFVFVHNNTSVIQDEVLAQRLGLIPLKGSVDGINWMRWFKKATEDDPEGSDPSDYNTIVLRLDIECTKNPNADATENDPRKLYKNAHVYARDITFHPVGRQEQFFTGEDAIQPVNPDILIAKLRPGQKIDLEMHCIKGIGADHAKFSPVATASYRLLPDIQILRPILGEDAKKFAKCFPKGVIGLEPVTREEAAKQGSGYEGHEGETKAVVRDAFKDTVSRECLRHEEFQGKVKLGRVRDHFIFNIESTGQFDSDVLFLESVKVLKLKCARWKRGLADLMR

SEQ ID NO: 14359 - DNA, 1128 bp, Arabidopsis thaliana
  CDS (1)..(1128)
atggtgactaaagcagaaaaacaattcgccaaaaatttcaacatagacgatctccctgacgtccctgccggacttcctccacatctcaaagcccagcaaactcgtgtcgtctctaaaaacaacgctcctgctcatactgcgagtgccatttactcgggtacctatgtttcttctacggaagaggacgacaatgtgaagctaggaaacttctatgataacttcaaagttgatgtggttagtctcacaaagacagatatggaatttgatatgattggtattgatgcagcgtttgccaatgcattccgaaggatccttatagctgaggttccttcaatggctattgaaaaagtgttgatagcgtacaacacatcggttattatagacgaagttcttgctcacaggatgggtcttattccaattgccgcagatccacgactttttgagtatttatccgaacatgatcaggcgaatgaaaagaacaacattgttttcaaactccatgtgaaatgtccgaaaaatagaccacgtcttaaagttttaacgagtgatttaaaatggttaccaaatggaagtgagcttctgagagaatcggaaaataaaacctcaaagccaaaaacttacacttcattcagttgcagccaagattcattacctgaatttgctaataatcctatcactccatgcgacctcgatatcttgatagcaaaactcgcccctggtcaggaaatcgagctcgaagctcatgcggttaagggcattggtaaaacacatgcaaagtggtctccagtagggactgcttggtatagaatgcatcctgaggtggttctacgtggggaagttgaggatgaacttgctgaacgacttgtaaacgtctgcccacagaatgttttcgacattgaagacatgggaaaaggtaagaaaagggcaacagtagcgcagccacgtaagtgcacattgtgtaaggaatgcgtaagagacgatgatttggtagaccatgtggatcttggcagtgttaagaaccattttatatttaacattgagtccaccggatcactgcctccagaggttctcttcactgaagctgtgaagatattggaagctaaatgtgaagctataaccgacttttga

SEQ ID NO: 14360 - protein, 375 aa, Arabidopsis thaliana
MVTKAEKQFAKNFNIDDLPDVPAGLPPHLKAQQTRVVSKNNAPAHTASAIYSGTYVSSTEEDDNVKLGNFYDNFKVDVVSLTKTDMEFDMIGIDAAFANAFRRILIAEVPSMAIEKVLIAYNTSVIIDEVLAHRMGLIPIAADPRLFEYLSEHDQANEKNNIVFKLHVKCPKNRPRLKVLTSDLKWLPNGSELLRESENKTSKPKTYTSFSCSQDSLPEFANNPITPCDLDILIAKLAPGQEIELEAHAVKGIGKTHAKWSPVGTAWYRMHPEVVLRGEVEDELAERLVNVCPQNVFDIEDMGKGKKRATVAQPRKCTLCKECVRDDDLVDHVDLGSVKNHFIFNIESTGSLPPEVLFTEAVKILEAKCEAITDF

SEQ ID NO: 14361 - DNA, 1128 bp, Arabidopsis thaliana
  CDS (1)..(1128)
atggtgactaaagcagaaaaacaattcgccaaaaatttcaacatagacgatctccctgacgtccctgccggacttcctccacatctcaaagcccagcaaactcgtgtcgtctctaaaaacaacgctcctgctcatactgcgagtgccatttactcgggtacctatgtttcttctacggaagaggacgacaatgtgaagctaggaaacttctatgataacttcaaagttgatgtggttagtctcacaaagacagatatggaatttgatatgattggtattgatgcagcgtttgccaatgcattccgaaggatccttatagctgaggttccttcaatggctattgaaaaagtgtttatagcgtacaacacatcggttattatagacgaagttcttgctcacaggatgggtcttattccaattgccgcagatccaagactttttgaatatttatccgaacatgatcaggcgaatgaaaagaacaccattgtattcaaactccatgtgaaatgtccgaaaaatagaccacgtcttaaagttttaacgagtgatttaaaatggttaccaaatggaagtgagcttctgagagaatcggaaaataaaacctcaaagctaaaaacttacacttcattcagttgcagccaagattcattacctgaatttgctaataatcctatcactccatgcgacctcgatatcttgatagcaaaactcgcccctggtcaggaaatcgagctcgaagctcatgcggttaagggcattggtaaaacacatgcaaagtggtctccagtagggactgcttggtatagaatgcatcctgaggtggttctacgtggggaagttgaggatgaacttgctgaacgacttgtaaacgtctgcccacagaatgttttcgacattgaagacatgggaaaaggtaagaaaagggcaacagtagcgcagccacgtaagtgcacattgtgtaaggaatgcgtaagagacgatgatttggtagaccatgtggatcttggcagtgttaagaaccattttatatttaacattgagtccaccggatcactgcctccagaggttctcttcactgaagctgtgaagatattggaagctaaatgtgaagctataaccgacttttga

SEQ ID NO: 14362 - protein, 375 aa, Arabidopsis thaliana
MVTKAEKQFAKNFNIDDLPDVPAGLPPHLKAQQTRVVSKNNAPAHTASAIYSGTYVSSTEEDDNVKLGNFYDNFKVDVVSLTKTDMEFDMIGIDAAFANAFRRILIAEVPSMAIEKVFIAYNTSVIIDEVLAHRMGLIPIAADPRLFEYLSEHDQANEKNTIVFKLHVKCPKNRPRLKVLTSDLKWLPNGSELLRESENKTSKLKTYTSFSCSQDSLPEFANNPITPCDLDILIAKLAPGQEIELEAHAVKGIGKTHAKWSPVGTAWYRMHPEVVLRGEVEDELAERLVNVCPQNVFDIEDMGKGKKRATVAQPRKCTLCKECVRDDDLVDHVDLGSVKNHFIFNIESTGSLPPEVLFTEAVKILEAKCEAITDF

SEQ ID NO: 14363 - DNA, 1047 bp, Schizosaccharomyces pombe
  CDS (1)..(1047)
atggcagcggttgacagatcaaggacagaaatctctgtcctttctgatcgtgttacagatgtaggaagtgtagattttccaggttattattttgatgaagacaacatctgggatcttgataaatttaaaaaaaatttaaaagtttcgattacgtctctcgatcaagaaacaatggtatttgaaatttctggaattgatgcatccattgcaaatgcatttaggaggattttaatcgccgagatcccaactcttgcatttgagttcgtgtatatcataaacaatacgagcataatacaagatgaggttttgtctcacagaataggtcttgtacctatatctgctgatcctgacatgtttaaatggtttcaacatcctctgccaggacaagaggcaactcatactgattacgatactgttgtcttttcccttaataagaaatgcgagtttaataagaatgccgctacagatgaaaaagatccaaagagactttacgttaactctgaggtttattcgggtgatctaatttggaaaccgcaaggtcgacaggaagagcgatttgctgacaatcctatacgagtagtcaacccagatattgttgttgcaaaattgcgtcctggccaggaaatcgatttagaagctcatgcaatcttaggtattggacaagaccatgctaagttttctcctgttgctactgcctcctaccgcttattgcctactatacatatcttgtctcctattgaaggtgaagatgcagttaaatttcaaaaatgcttccctaaaggagtcatcgagcttgaagaaggacctgatggtaaaaaacaagcccgtgtagcagacgttcgaaaagacaccgtatcccgcgaatgcttgagacatcccgaatttgcagataaggtgcaattaggccgcgtacgcgatcattatttgttttctgttgaaagcaccggtattatgaagcccgatgtcttgttcattaaaagcattgcagtcctaaaatcgaaatgtctagccgtaaagtctagtcttcagaatatttcttctgactga

SEQ ID NO: 14364 - protein, 348 aa, Schizosaccharomyces pombe
MAAVDRSRTEISVLSDRVTDVGSVDFPGYYFDEDNIWDLDKFKKNLKVSITSLDQETMVFEISGIDASIANAFRRILIAEIPTLAFEFVYIINNTSIIQDEVLSHRIGLVPISADPDMFKWFQHPLPGQEATHTDYDTVVFSLNKKCEFNKNAATDEKDPKRLYVNSEVYSGDLIWKPQGRQEERFADNPIRVVNPDIVVAKLRPGQEIDLEAHAILGIGQDHAKFSPVATASYRLLPTIHILSPIEGEDAVKFQKCFPKGVIELEEGPDGKKQARVADVRKDTVSRECLRHPEFADKVQLGRVRDHYLFSVESTGIMKPDVLFIKSIAVLKSKCLAVKSSLQNISSD

SEQ ID NO: 14365 - DNA, 960 bp, Arabidopsis thaliana
  CDS (1)..(960)
atggacggtgtcacctaccaaagattcccaacggtgaagatccgtgagcttaaagatgactacgccaagttcgagcttcgtgaaaccgacgtttcaatggccaacgctctccgtcgcgtaatgatctccgaagtccccaccatggcaatccatctcgtcaaaatcgaggttaattcctctgttctcaacgacgagttcattgctcaacgacttagtctcatccctctcactagcgagcgtgctatgagcatgcggttctgtcaagattgtgaagattgtaatggagatgaacattgcgagttctgctctgttgagtttccccttagtgctaagtgtgttactgaccaaaccctagatgttactagtagggatctctacagtgctgatcctactgttactcctgttgatttcactagtaactcatctacttctgattcaagcgagcacaagggaattatcattgcgaaactacgcaggggacaagagttgaagcttaaagcattagctaggaaaggaattgggaaagatcatgcgaaatggtctcctgcagctactgttacgtatatgtatgagcctgacattattatcaatgaagagatgatgaacactttgacagatgaggaaaaaattgacttgattgagagcagtcctaccaaagtgtttggcattgacccagtcaccggacaggttgtggtggttgatcctgaagcatacacttacgatgaagaagtgatcaagaaagctgaagcaatggggaaaccgggactcattgagatccatccgaaacatgatagttttgtattcactgttgagtccacaggtgcattgaaggcttctcagctggtactaaatgccattgatatcctgaagcagaagcttgatgcaatccgtctctcagataacactgtagaagccgatgatcagtttggtgaactcggtgcccatatgcgtgaaggatga

SEQ ID NO: 14366 - protein, 319 aa, Arabidopsis thaliana
MDGVTYQRFPTVKIRELKDDYAKFELRETDVSMANALRRVMISEVPTMAIHLVKIEVNSSVLNDEFIAQRLSLIPLTSERAMSMRFCQDCEDCNGDEHCEFCSVEFPLSAKCVTDQTLDVTSRDLYSADPTVTPVDFTSNSSTSDSSEHKGIIIAKLRRGQELKLKALARKGIGKDHAKWSPAATVTYMYEPDIIINEEMMNTLTDEEKIDLIESSPTKVFGIDPVTGQVVVVDPEAYTYDEEVIKKAEAMGKPGLIEIHPKHDSFVFTVESTGALKASQLVLNAIDILKQKLDAIRLSDNTVEADDQFGELGAHMREG

SEQ ID NO: 14367 - DNA, 960 bp, Arabidopsis thaliana
  CDS (1)..(960)
atggacggtgccacataccaaagattcccaaagatcaagatccgtgagcttaaagatgattacgccaagttcgagcttcgtgaaaccgacgtttctatggccaacgctctccgtcgcgtaatgatctccgaagtccctaccgtcgcaatagatctagtcgaaatcgaggttaattcatctgtactcaacgacgagttcattgctcatcgattaggtctcattcctctcactagcgaacgtgctatgagcatgcgtttctctcgagattgtgatgcttgtgatggagatggacaatgcgagttttgctctgttgagtttcggcttagttctaagtgtgttactgatcaaaccctagatgttactagtagggatttgtacagtgctgatcctactgttactcctgtggatttcactattgactcgtctgtatctgattcaagcgagcacaagggaattatcattgtgaaactgcgtcggggacaagagttgaagcttagagcgatagcgaggaaagggattgggaaagatcatgcgaaatggtctcctgcagctactgttacgtttatgtatgagcctgacataattattaatgaagatatgatggatactttgtcagacgaggaaaagatcgacttgattgagagcagtcctaccaaagtgtttggcatggatccagtcaccagacaggttgtagtggttgatcctgaagcatacacttacgatgaagaagtgatcaagaaagctgaagcaatggggaaaccgggactcattgagatcagtccgaaagatgacagttttatattcactgttgagtccacaggtgcagtgaaggcttcccaactggtactaaatgccattgatcttctgaagcagaagcttgatgcagtccgtctctcagatgacaccgtagaagcggatgatcagtttggtgaactcggtgcccatatgcgtggaggatga

SEQ ID NO: 14368 - protein, 319 aa, Arabidopsis thaliana
MDGATYQRFPKIKIRELKDDYAKFELRETDVSMANALRRVMISEVPTVAIDLVEIEVNSSVLNDEFIAHRLGLIPLTSERAMSMRFSRDCDACDGDGQCEFCSVEFRLSSKCVTDQTLDVTSRDLYSADPTVTPVDFTIDSSVSDSSEHKGIIIVKLRRGQELKLRAIARKGIGKDHAKWSPAATVTFMYEPDIIINEDMMDTLSDEEKIDLIESSPTKVFGMDPVTRQVVVVDPEAYTYDEEVIKKAEAMGKPGLIEISPKDDSFIFTVESTGAVKASQLVLNAIDLLKQKLDAVRLSDDTVEADDQFGELGAHMRGG

SEQ ID NO: 14369 - DNA, 1059 bp, Oryza sativa
  CDS (1)..(1059)
atgccgaagaaggggacgaaatcgaggaagggcacggacgatgagcccaagcaggaggagaagaacaagcttccggagcaccttgaggtccagcggacgcgtgtggtctgcaagggcgacgcccccgtaaatactgaaggttttcaatacgctggtgcttttgctgctatgggaatcgataacagtgtctcagcggataagttttgcaaaaactttaaagtcgtggtaaatcgacttacggaagatgatatggagtttgatatgattggtattgatgcatcaatggctaatgcttttcggagaatccttatagcagaggttcctacaatggcaattgagaaagttttaatggctgacaatacctcagttatagcagatgaagttctttcacatagacttggccttattccacttgatgcagatcctaggctttttgaatatatctcagaaaatgatgtcccaactgaaagaaacactattgtgtacaaactccatgtttcatgtaaaaagggttccccacggcttacagtgaagtctggtgatttagagtggctgccagaaggtagccaactacctttggcatctcctgctcaatctggggacaaacaaaagacgtacacttccttcagccaaagccagaaggatatcttagaaaagcctcttggtgtgaaatttaaagacataactattgcgaggcttgggccaggccaggctattgaacttgaggtacatgctgttaagggaataggaaaagtgcatgccaagtggtccccagttgctacagcttggtatagaatgctccctgaggttgttcttcgtgaagaaatcaaagatgctgatgcagagatgctagtggcaaagtgcccagtcaatgtttttgacatcgaagacctgggaaacggggaaaagagagcggttgttgctaggccaagagcatgcaccctttgtaggcaatgcgttatgggacctactggggaagttatgggacctacttttttcacggttatattctgttgggagggtgtttgtgctaagatttatctcctgacgaagagctga

SEQ ID NO: 14370 - protein, 352 aa, Oryza sativa
MPKKGTKSRKGTDDEPKQEEKNKLPEHLEVQRTRVVCKGDAPVNTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTVKSGDLEWLPEGSQLPLASPAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTFFTVIFCWEGVCAKIYLLTKS

SEQ ID NO: 14371 - DNA, 993 bp, Oryza sativa
  CDS (1)..(993)
atggagcgggcggcaggcggcgtgtcgtaccagcggttcccgcgggtgcggatccgcgagctgaaggacgactacgccaagttcgagctccgcgacaccgacgccagcatggccaacgccctccgccgcgtcatgatcgccgaggtccccaccgtcgccatcgacctcgtcgagatcgaggtcaactcctccgtcctcaacgacgagttcatcgcccaccgcctcggcctcatccccctcacctccgccgccgccatggccatgcgcttctcccgcgactgcgacgcctgcgacggcgacggctcctgcgagtactgctccgtcgagttccacctcgccgcccgcgccaccgactccgaccagaccctcgaggtcacctccaacgacctccgctccaccgaccccaaggtctgccccgtcgaccaggctagggcctaccagcacgccctcggcggaactgaacccttcgacaccgccgctgctgctgaccagaggggcatactaattgtaaagctgcgtcggggccaagagctcaggctccgagcaattgctaggaagggaattggcaaggaccatgccaagtggtcccccgccgctactgtgactttcatgtatgagcctgaaatacgtatcaatgaagaactcatggaaacattgacactcgaggaaaaacgaaatttggtggagagtagccctacaaaagtgttcaacattgatcccaacactcaacaggtggtagttgaggatgcagaggcatatacatatgatgatgaggtcatcaagaaagcagatgccatgggaaagcccggattgatagagatcaatgccaaggaggacagctttatcttcactgttgaaacaactggcgctatcacagcttatgagctgatcatgaacgctatcacggtcttgaggcaaaagttagatgctgttcgtctacaagatgacgatgctgaccttggcgagcttggtgcccaccttgttggaggctaa

SEQ ID NO: 14372 - protein, 330 aa, Oryza sativa
MERAAGGVSYQRFPRVRIRELKDDYAKFELRDTDASMANALRRVMIAEVPTVAIDLVEIEVNSSVLNDEFIAHRLGLIPLTSAAAMAMRFSRDCDACDGDGSCEYCSVEFHLAARATDSDQTLEVTSNDLRSTDPKVCPVDQARAYQHALGGTEPFDTAAAADQRGILIVKLRRGQELRLRAIARKGIGKDHAKWSPAATVTFMYEPEIRINEELMETLTLEEKRNLVESSPTKVFNIDPNTQQVVVEDAEAYTYDDEVIKKADAMGKPGLIEINAKEDSFIFTVETTGAITAYELIMNAITVLRQKLDAVRLQDDDADLGELGAHLVGG

SEQ ID NO: 14373 - DNA, 1110 bp, Helianthus annuus
  CDS (1)..(1110)
atgccgaaagttccgctttgggatctgccggaactgccccaaaatcagcttcctcttcatcttcaactccagaaaactcgcgtctcctgcaacaacgatgctccaactaatacagagaatgttacttactccggtgcgtacgcagcactgggagttgataacagcttaaggttggatgaatttaggaacaactttaatgtcaaagtgattaagctcaatgaagaagatatggagtttgatttgatcggaatcgatgcttcgattgcgaatgcttttagaagaatcctcatatctgagttgcctactatggctattgagaaagttcttgttgcaaacagttcatcagtggtacaagacgaagtacttgcccaccgattgggtctcgttccgataaaagtcgatccaagactgttcgattatatgtcagaaaatgatgtcccgaacgagaaaaacagcattgttttcaaactccatgtcaagtgtgagcgaaaatccggtgaacgcctcacagtgtactctcatgatctcgagtggttaccgtctggcagtgaatatgttttgcccactgaaaattcttcagaatcgaaaccgaaaacatacacgtcatttacttctagccaagtctctttgccagaatttgcaaataatcctatcactgtcactcctggtatcattatatcaaaacttgcgcctgggcaggaaattgagctagaagcgcatgctgttaaaggtgttggtaaaacacatgcaaagtggtctccagttgccactgcgtggtaccgaatgctccctgaggttgtattgctgcaagatatcgaggacgaggatgctcaaaaacttgtaaacaaatgtcccgttaacgtgtttgacattgaagatatgggcaaaggtgtgaagagggcaactgtggctagaccgagagcttgtaccctgtgtcgggaatgcattagagagcctggatgggaggaaaaggtggcattaagacgcgtgaaagatcattttatcttcactattgaatcaactggagccttgccaccggaggtgttatttactgaagctgtcaagattttagaagacaagtgtgaaagtgtaataaccgagctctcatag

SEQ ID NO: 14374 - protein, 369 aa, Helianthus annuus
MPKVPLWDLPELPQNQLPLHLQLQKTRVSCNNDAPTNTENVTYSGAYAALGVDNSLRLDEFRNNFNVKVIKLNEEDMEFDLIGIDASIANAFRRILISELPTMAIEKVLVANSSSVVQDEVLAHRLGLVPIKVDPRLFDYMSENDVPNEKNSIVFKLHVKCERKSGERLTVYSHDLEWLPSGSEYVLPTENSSESKPKTYTSFTSSQVSLPEFANNPITVTPGIIISKLAPGQEIELEAHAVKGVGKTHAKWSPVATAWYRMLPEVVLLQDIEDEDAQKLVNKCPVNVFDIEDMGKGVKRATVARPRACTLCRECIREPGWEEKVALRRVKDHFIFTIESTGALPPEVLFTEAVKILEDKCESVITELS

SEQ ID NO: 14375 - DNA, 1251 bp, Brassica napus
  CDS (75)..(1031)
tcccgggtcgacgatttcgtgcgagaaaccctttggatcctaaaaccctaaaaagatcgcaacgagctttagacatggacactggtgccacttaccagagattcccaaaggtgaagatccgcgagctcaaagacgactacgccaagttcgagcttcgcgacaccgacgtatccatggccaacgccctccgccgcgtcatgatctccgaagtccccaccgtcgcgatcgacctcgtcgagatcgaggtcaactcctccgtcctcaacgacgagttcatcgctcatcgcctgggtctcatccctctcaccagcgagagggccatgagcatgcgcttctctcgagactgcgatgcttgcgacggagatggacagtgcgagttttgctccgtcgagtttcatcttaacgctaaatgtgttacggaccaaaccctcgatgttactagtagggatttgtacagtgctgatgctaccgttactcctgttgacttcggcgtcgattcatctgattcaggcgagcaaaggggaattatcatagtgaaactgcggcgtggacaagaactgaagctaagggcaatagcgaggaaaggaatcgggaaagatcacgcgaaatggtctcctgcagccacggttacgttcatgtatgagcctgacataattatcaacgaagatatgatggacactttgacagacgacgaaaagatcgacttgattgagagcagcccgaccaaagtttttgactttgatgcagtcaccagacaggttgtggtggttgatccagaagcatacacttacgatgaagaagtgatcaagaaagcagaagccatggggaaacaagggctcattgagatacgtccgaaagacgacagttttatattcaccgttgaatccacaggtgcagtgaaggcctcgcagctggtactgaatgccatagatctcctgaagcagaagctcgatgcagtccgtctctcagacgacactgttgaagctgatgatcagtttggcgaactaggtgcacatatgcgcggaggatgagcgtgtggtttaatttgtgctccatgttttccccagtttgtttcgggtttgagtttatgtttggaccagggcaatctattttaccgtagcgggacactcttcttagataactacttatgaagcaggtggtcttctgttttggcccctgcaaactgatcccttcttaaatcttgttattatgtgattcagactaaagtttatccaaaaaaaaaaaaaaaaa

SEQ ID NO: 14376 - protein, 318 aa, Brassica napus
MDTGATYQRFPKVKIRELKDDYAKFELRDTDVSMANALRRVMISEVPTVAIDLVEIEVNSSVLNDEFIAHRLGLIPLTSERAMSMRFSRDCDACDGDGQCEFCSVEFHLNAKCVTDQTLDVTSRDLYSADATVTPVDFGVDSSDSGEQRGIIIVKLRRGQELKLRAIARKGIGKDHAKWSPAATVTFMYEPDIIINEDMMDTLTDDEKIDLIESSPTKVFDFDAVTRQVVVVDPEAYTYDEEVIKKAEAMGKQGLIEIRPKDDSFIFTVESTGAVKASQLVLNAIDLLKQKLDAVRLSDDTVEADDQFGELGAHMRGG

SEQ ID NO: 14377 - DNA, 1559 bp, Glycine max
  CDS (132)..(1091)
gaggggtgatgaatattaagttagaataaaggatcgcgagaagaggggggggtgtggagaagggttttacattttattcgttctccggtgaaacagaaacacacagaagacagagtgagacgcttctcacgatggagggaggagtatcctacgcgcgcatgcctcgggtcaaaatccgcgagctgaaggacgactacgccaagttcgagctccgcgacaccgacgcgagcatcgccaacgcgctgcggcgcgtgatgatcgcggaggtgccgacggtcgccatcgacctcgtggagatcgaggtcaactcctcggtgctcaatgacgagtttatcgctcacaggctgggcctcatccccctcactagcgagcgcgccatgtccatgcgcttctcacgtgactgcgacgcgtgcgacggtgacggacagtgcgagttttgctccgtcgagtttcatcttagggtaaagtgcatgactgatcagaccctcgatgttacgagcaaggacctctacagttctgaccctactgtcagtcccgttgatttctctgacccctctgccactgactccgacaacaacagggggattatcattgtgaagttgcggcgcggacaagagctgaagctgagagcgatagctaggaaggggattgggaaggatcatgctaaatggtcacctgctgcaactgtcactttcatgtatgaaccggagattcatataaatgaggatttgatggaaaccttgactctggaagagaaaagagaatgggttgacagtagtccaacccgtgtctttgaaattgatccagtgacacaacaggtgatggtggttgatgctgaggcatacacatatgatgatgaggtgcttaagaaagcagaagctatgggcaagcctgggcttgtagaaatcattgcgaggcaggatagcttcatattcactgtggagtctactggagcggttaaagcttctcaattggttctaaatgccatagaaattctcaagcagaagctggatgctgtgaggctatctgaagatacagtggaggctgatgatcagtttggcgagcttggtgcacatatgcgaggaggttgattaatttgttagaaggatatcagacttgtttcccacaacttgtttcccggaacttgtttcttacttgtctttaactgaatacctgcagaacgtattaacttgttgagccaaggatgctaattagtaattactgtgattaccatttgaagatagatagttatctttcacattttattttacttagcttgccagaaacagtggttaccatatggtatttttttaatcacacaaactggagctctatcctcttgtcatctggcttggggagagggataggattaaacggattaagcagtctcccaaagagttaggatcacttaggctgcgaagcttttagaatattttaccgagtatttatcatgtttgttttctttattgtttataatggtcaaaagggataacttattggtttgtgaacaaataaaaagaaaagtaatgtatgtgatccttctcatacaaggataggcc

SEQ ID NO: 14378 - protein, 319 aa, Glycine max
MEGGVSYARMPRVKIRELKDDYAKFELRDTDASIANALRRVMIAEVPTVAIDLVEIEVNSSVLNDEFIAHRLGLIPLTSERAMSMRFSRDCDACDGDGQCEFCSVEFHLRVKCMTDQTLDVTSKDLYSSDPTVSPVDFSDPSATDSDNNRGIIIVKLRRGQELKLRAIARKGIGKDHAKWSPAATVTFMYEPEIHINEDLMETLTLEEKREWVDSSPTRVFEIDPVTQQVMVVDAEAYTYDDEVLKKAEAMGKPGLVEIIARQDSFIFTVESTGAVKASQLVLNAIEILKQKLDAVRLSEDTVEADDQFGELGAHMRGG

SEQ ID NO: 14379 - DNA, 990 bp, Zea mays
  CDS (1)..(987)
atggaccgcccttccggcacatcgtaccagcgctttccccgcgttcggatccgcgagctcaaggacgactacgccaagttcgaactccgcgacaccgacgctagcatggccaacgccctccgccgcgtcatgatcgccgaagtcccaactgtcgccatcgatctcgtagagatcgaggttaactcctccgtcctcaacgacgagttcatcgcccaccgtctggggctcatcccgctcacctccgccgccgccatgcaaatgcgcttctctcgggactgcgacgcttgcgacggcgacggctcctgcgagtactgctccgtcgagtttcacctctccgtgcacgccaccgactctgaccagacgctcgaggtcacatccaacgacctgagatccatggaccccaaggtctgcccagtcgaccaagcacgcgcctaccagcacgcgctcggaggcaccgacccctttggagccaatgcctcgaacgaaaacaggggcatacttattgtaaagctgcgtcggggacaagaactaaggcttcgtgccatagctaggaaaggaattggcaaggaccatgccaaatggtcaccagctgctaccgtgactttcatgtatgagcctgacatacgtatcaatgaagaactaatggaaacattgacggtggaagagagaataagcttgattgaaagcagccctacaaaagtatttgagcttgattctgccaatcaggtggtggtgaaaaacgcggaggcatacacctacgacgacgaggtgatcaagcacgccgaggccatcgggaagccaggcttggtggagatcaccgccaaggaggacagcttcgtcttcaccgtagaaacaaccggtgccatcacagcctacgagctgatcatgaacgccatcacggtgctgaggcagaagctggatgccgtccgccttcaggacgacgacggcgaccttggcgagctcggcgcccaccttggtgggccttaggag

SEQ ID NO: 14380 - protein, 328 aa, Zea mays
MDRPSGTSYQRFPRVRIRELKDDYAKFELRDTDASMANALRRVMIAEVPTVAIDLVEIEVNSSVLNDEFIAHRLGLIPLTSAAAMQMRFSRDCDACDGDGSCEYCSVEFHLSVHATDSDQTLEVTSNDLRSMDPKVCPVDQARAYQHALGGTDPFGANASNENRGILIVKLRRGQELRLRAIARKGIGKDHAKWSPAATVTFMYEPDIRINEELMETLTVEERISLIESSPTKVFELDSANQVVVKNAEAYTYDDEVIKHAEAIGKPGLVEITAKEDSFVFTVETTGAITAYELIMNAITVLRQKLDAVRLQDDDGDLGELGAHLGGP

SEQ ID NO: 14381 - DNA, 1601 bp, Zea mays
  CDS (140)..(1258)
gcaaccgcgtcagcagctgcccctcccgcttctcgccagtcgcaccgtgccctcgcctccggtcctcagcacaccagccgtgaccctgcgtcataacagcggtacaagggtgaacaaagaacatcgagaggaagacaatatgccgaagaaggggactaaatctaagaaggagaaggtggacgatgtgcccaatgaacaagaaaataagcttccagactacctggagctccagcgcacacgtgtcgtctgcaatgctgatgcccccattcatactcaaggtttccaatactcgggtgcatttgctgctatgggaattgataatagcgtgtcagtggataaattttgcaagaatttcaaaattgaaataaatcgtctcactgaagattatatggagttcgatatgattggtattgatgcatcaatagccaatgctttccggagaatcctcatttcagaggttccaactatggcaattgagaaagtcttcatggctgacaacaactcagttatagcagatgaggttctttcacatagactaggacttattccacttgatgcagatccaagactctttgaatatatctcagaaaacgatgtcccaaatgaaaggaatactattgtttataaactgcacgtttcttgtccaaagaattctcaacgaattacagtgaaatctagtgaactagagtggttaccagaaggtagccaattaagcatgtcagcccctgcacagtctggagacaaacagaagactttcacttccttcagtcaaagccaaaaggagatcttagaaaagcctcttggtgtgaagtataaagatattactattgccaggcttgggccaggacaggctatcgagctcgaggcacatgctgttaagggaactgggaacgttcacgccaagtggtctccagttgctacagcctggtacagaatgctccctgaggttgttattcttaaagaagttgaaggccctcaggcagaggagctggtgaataagtgccgggttaatgtttttgacatcgaagacctggctaacggtggaaagagggcggttgttgcgaggccaagggcatgcacactctgcagagaatgtgtgatgggaccaaatgagaaacaagtggagctacggcgtgtcagagaccatttcatattcaccatcgagtccaccggaagcatgcccccggaggtgctgttcacagaagccgtgaagattttggaagagaagtgcgcgagggtcatatctgagctatcctgagaggccggcggcactgtgcagcactggagttagagtaaaccagctcaggctgcagtatctgctgtttttgatggagactagtgtgcgccattaaacattttttttgtggtgttggatatttgggtcagcaaatgtaagctgtttatatcatgtaacgcagtgtaatgttagattaaactgtggcaggtgatcgaaatggcagctgtatcaaaggtagacgtcggctgttagtccgcaagcactgtgtttttgcgtttaggtaggtgactcggctcaggttacatggaaaatgaattatttttttcttgagaaaaatgaaaattgcttgaaaaaaaaaaaaaaa

SEQ ID NO: 14382 - protein, 372 aa, Zea mays
MPKKGTKSKKEKVDDVPNEQENKLPDYLELQRTRVVCNADAPIHTQGFQYSGAFAAMGIDNSVSVDKFCKNFKIEINRLTEDYMEFDMIGIDASIANAFRRILISEVPTMAIEKVFMADNNSVIADEVLSHRLGLIPLDADPRLFEYISENDVPNERNTIVYKLHVSCPKNSQRITVKSSELEWLPEGSQLSMSAPAQSGDKQKTFTSFSQSQKEILEKPLGVKYKDITIARLGPGQAIELEAHAVKGTGNVHAKWSPVATAWYRMLPEVVILKEVEGPQAEELVNKCRVNVFDIEDLANGGKRAVVARPRACTLCRECVMGPNEKQVELRRVRDHFIFTIESTGSMPPEVLFTEAVKILEEKCARVISELS

SEQ ID NO: 14383 - DNA, 27 bp, Artificial sequence
  primer
atgtcaaatattgtgggtattgaatat

SEQ ID NO: 14384 - DNA, 25 bp, Artificial sequence
  primer
tcattgggtaattggacagtttttc

SEQ ID NO: 14385 - protein, 347 aa, Artificial sequence
  consensus sequence
  Variant (2)..(6): Xaa in position 2 to 6 is any amino acid
  Variant (8)..(8): Xaa in position 8 is any amino acid
  Variant (10)..(10): Xaa in position 10 is any amino acid
  Variant (14)..(14): Xaa in position 14 is any amino acid
  Variant (18)..(18): Xaa in position 18 is any amino acid
  Variant (20)..(20): Xaa in position 20 is any amino acid
  Variant (24)..(25): Xaa in position 24 to 25 is any amino acid
  Variant (27)..(29): Xaa in position 27 to 29 is any amino acid
  Variant (31)..(34): Xaa in position 31 to 34 is any amino acid
  Variant (36)..(36): Xaa in position 36 is any amino acid
  Variant (39)..(40): Xaa in position 39 to 40 is any amino acid
  Variant (43)..(45): Xaa in position 43 to 45 is any amino acid
  Variant (48)..(48): Xaa in position 48 is any amino acid
  Variant (51)..(51): Xaa in position 51 is any amino acid
  Variant (53)..(76): Xaa in position 53 to 76 is any amino acid
  Variant (77)..(89): Xaa in position 77 to 89 is any or no amino acid
  Variant (91)..(91): Xaa in position 91 is any amino acid
  Variant (93)..(93): Xaa in position 93 is any amino acid
  Variant (95)..(110): Xaa in position 95 to 110 is any amino acid
  Variant (111)..(124): Xaa in position 111 to 124 is any or no amino acid
  Variant (126)..(140): Xaa in position 126 to 140 is any amino acid
  Variant (141)..(170): Xaa in position 141 to 170 is any or no amino acid
  Variant (172)..(175): Xaa in position 172 to 175 is any amino acid
  Variant (177)..(178): Xaa in position 177 to 178 is any amino acid
  Variant (181)..(181): Xaa in position 181 is any amino acid
  Variant (183)..(183): Xaa in position 183 is any amino acid
  Variant (185)..(190): Xaa in position 185 to 190 is any amino acid
  Variant (192)..(192): Xaa in position 192 is any amino acid
  Variant (194)..(195): Xaa in position 194 to 195 is any amino acid
  Variant (199)..(199): Xaa in position 199 is any amino acid
  Variant (203)..(203): Xaa in position 203 is any amino acid
  Variant (205)..(206): Xaa in position 205 to 206 is any amino acid
  Variant (209)..(210): Xaa in position 209 to 210 is any amino acid
  Variant (212)..(230): Xaa in position 212 to 230 is any amino acid
  Variant (231)..(235): Xaa in position 231 to 235 is any or no amino acid
  Variant (237)..(238): Xaa in position 237 to 238 is any amino acid
  Variant (239)..(243): Xaa in position 239 to 243 is any or no amino acid
  Variant (245)..(253): Xaa in position 245 to 253 is any amino acid
  Variant (254)..(272): Xaa in position 254 to 272 is any or no amino acid
  Variant (274)..(279): Xaa in position 274 to 279 is any amino acid
  Variant (281)..(283): Xaa in position 281 to 283 is any amino acid
  Variant (285)..(294): Xaa in position 285 to 294 is any amino acid
  Variant (295)..(306): Xaa in position 295 to 306 is any or no amino acid
  Variant (308)..(309): Xaa in position 308 to 309 is any amino acid
  Variant (310)..(320): Xaa in position 310 to 320 is any or no amino acid
  Variant (324)..(325): Xaa in position 324 to 325 is any amino acid
  Variant (330)..(335): Xaa in position 330 to 335 is any amino acid
  Variant (337)..(340): Xaa in position 337 to 340 is any amino acid
  Variant (341)..(343): Xaa in position 341 to 343 is any or no amino acid
  Variant (345)..(346): Xaa in position 345 to 346 is any amino acid
FXXXXXDXSXANAXRRIXIXEVPXXAXXXVXXXXNXSVXXDEXXXHRXGLXPXXXXXXXXXXXXXXXXXXXXXXXXXXXXXXXXXXXXXLXVXCXXXXXXXXXXXXXXXXXXXXXXXXXXXXXXPXXXXXXXXXXXXXXXXXXXXXXXXXXXXXXXXXXXXXXXXXXXXXIXXXXLXXGQXIXLXXXXXXGXGXXHAKXSPVXTXXYRXXPXXXXXXXXXXXXXXXXXXXXXXXXPXXXXXXXVXXXXXXXXXXXXXXXXXXXXXXXXXXXXVXXXXXXTXXXEXXXXXXXXXXXXXXXXXXXXXXLXXXXXXXXXXXXXFIFXXESTGXXXXXXLXXXXXXXLXXK

SEQ ID NO: 14386 - protein, 52 aa, Artificial sequence
  protein pattern
  Variant (2)..(2): Xaa in position 2 is Ala, Cys, Pro, Thr or Val
  Variant (3)..(3): Xaa in position 3 is Ala or Ser
  Variant (4)..(4): Xaa in position 4 is Phe, Ile, Leu, Met or Val
  Variant (8)..(8): Xaa in position 8 is Phe or Leu
  Variant (11)..(12): Xaa in position 11 to 12 is any or no amino acid
  Variant (14)..(14): Xaa in position 14 is any amino acid
  Variant (15)..(16): Xaa in position 15 to 16 is any or no amino acid
  Variant (20)..(20): Xaa in position 20 is Ala, Ser or Thr
  Variant (21)..(21): Xaa in position 21 is Leu, Met or Val
  Variant (23)..(23): Xaa in position 23 is Ala, Ile, Pro or Val
  Variant (24)..(24): Xaa in position 24 is Asp, Glu, His or Arg
  Variant (25)..(25): Xaa in position 25 is any amino acid
  Variant (26)..(26): Xaa in position 26 is Ile or Val
  Variant (27)..(27): Xaa in position 27 is any amino acid
  Variant (28)..(28): Xaa in position 28 is Phe, Ile, Leu, Met or Val
  Variant (29)..(30): Xaa in position 29 to 30 is any amino acid
  Variant (32)..(32): Xaa in position 32 is Glu, Asn, Ser or Thr
  Variant (34)..(34): Xaa in position 34 is Leu or Val
  Variant (35)..(35): Xaa in position 35 is Phe, Ile, Leu or Val
  Variant (36)..(36): Xaa in position 36 is any amino acid
  Variant (39)..(39): Xaa in position 39 is Phe or Val
  Variant (40)..(40): Xaa in position 40 is Ile or Leu
  Variant (41)..(41): Xaa in position 41 is Ala or Ser
  Variant (42)..(42): Xaa in position 42 is any amino acid
  Variant (44)..(44): Xaa in position 44 is Ile, Leu or Met
  Variant (45)..(45): Xaa in position 45 is Gly or Ser
  Variant (47)..(47): Xaa in position 47 is Ile or Val
  Variant (49)..(51): Xaa in position 49 to 51 is any amino acid
  Variant (52)..(52): Xaa in position 52 is Ala, Asp, Glu or Ser
DXXXANAXRRXXIXXXEVPXXAXXXXXXXXNXSXXXDEXXXXRXXLXPXXXX

SEQ ID NO: 14387 - protein, 56 aa, Artificial sequence
  protein pattern
  Variant (2)..(2): Xaa in position 2 is any amino acid
  Variant (3)..(3): Xaa in position 3 is Ile, Leu or Val
  Variant (4)..(4): Xaa in position 4 is Ala or Val
  Variant (5)..(5): Xaa in position 5 is Lys or Arg
  Variant (7)..(8): Xaa in position 7 to 8 is any or no amino acid
  Variant (10)..(11): Xaa in position 10 to 11 is any or no amino acid
  Variant (13)..(13): Xaa in position 13 is any amino acid
  Variant (14)..(14): Xaa in position 14 is Ile or Leu
  Variant (15)..(15): Xaa in position 15 is any amino acid
  Variant (17)..(19): Xaa in position 17 to 19 is any amino acid
  Variant (20)..(20): Xaa in position 20 is Ala or Cys
  Variant (21)..(22): Xaa in position 21 to 22 is any amino acid
  Variant (24)..(24): Xaa in position 24 is any amino acid
  Variant (26)..(26): Xaa in position 26 is any amino acid
  Variant (27)..(27): Xaa in position 27 is Asp, Thr or Val
  Variant (31)..(31): Xaa in position 31 is Phe or Trp
  Variant (34)..(34): Xaa in position 34 is Ala or Val
  Variant (35)..(35): Xaa in position 35 is Ala, Cys, Gly or Ser
  Variant (37)..(37): Xaa in position 37 is Ala or Val
  Variant (38)..(38): Xaa in position 38 is any amino acid
  Variant (39)..(39): Xaa in position 39 is Phe or Tyr
  Variant (40)..(42): Xaa in position 40 to 42 is any amino acid
  Variant (44)..(44): Xaa in position 44 is any amino acid
  Variant (45)..(45): Xaa in position 45 is Ile or Val
  Variant (46)..(46): Xaa in position 46 is any amino acid
  Variant (47)..(47): Xaa in position 47 is Ile or Leu
  Variant (48)..(50): Xaa in position 48 to 50 is any amino acid
  Variant (51)..(51): Xaa in position 51 is Phe, Ile, Leu, Met or Val
  Variant (52)..(52): Xaa in position 52 is any amino acid
  Variant (53)..(53): Xaa in position 53 is Asp, Glu, Gly or Asn
  Variant (54)..(55): Xaa in position 54 to 55 is any amino acid
  Variant (56)..(56): Xaa in position 56 is Ala, Ser or Thr
IXXXXLXXGXXQXXXLXXXXXXGXGXXHAKXSPXXTXXXXXXPXXXXXXXXXXXXX

SEQ ID NO: 14388 - protein, 21 aa, Artificial sequence
  protein pattern
  Variant (2)..(2): Xaa in position 2 is Ala or Thr
  Variant (4)..(6): Xaa in position 4 to 6 is any amino acid
  Variant (7)..(7): Xaa in position 7 is Ala, Pro or Ser
  Variant (8)..(8): Xaa in position 8 is Ala, Asp, Glu or Ser
  Variant (9)..(9): Xaa in position 9 is any amino acid
  Variant (10)..(10): Xaa in position 10 is Ile or Leu
  Variant (11)..(11): Xaa in position 11 is Phe, Leu or Val
  Variant (12)..(13): Xaa in position 12 to 13 is any amino acid
  Variant (14)..(14): Xaa in position 14 is Ala or Ser
  Variant (15)..(15): Xaa in position 15 is Ile or Val
  Variant (16)..(17): Xaa in position 16 to 17 is any amino acid
  Variant (19)..(19): Xaa in position 19 is Glu or Lys
  Variant (20)..(20): Xaa in position 20 is any amino acid
SXGXXXXXXXXXXXXXXLXXK

SEQ ID NO: 14389 - DNA, 9045 bp, Artificial; identical to SEQ ID NO: 1
  plasmid VC-MME220-1qcz

SEQ ID NO: 14390 - DNA, 8885 bp, Artificial
  plasmid VC-MME221-1qcz
agcttggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaagctttgggcggatcctctagaattcgaatccaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcccgggttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 14391 - DNA, 9469 bp, Artificial
  plasmid VC-MME354-1QCZ
  5'UTR (2130)..(2294)
  transit_peptide (2295)..(2402)
  CDS (2295)..(2402)
  transit_peptide (2480)..(2548)
  CDS (2480)..(2548)
  CDS (2549)..(2566): adapter
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattcgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctctgaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 14392 - protein, 65 aa, Artificial sequence
  Synthetic Construct
MTTAVTAAVSFPSTKTTSLSARSSSVISPDKISYKKVPLYYRNVSATGKMGPIRAQIASEFQLTT

SEQ ID NO: 14393 - DNA, 9466 bp, Artificial
  plasmid VC-MME432-1qcz
  5'UTR (2125)..(2289)
  transit_peptide (2290)..(2397)
  CDS (2290)..(2397)
  transit_peptide (2475)..(2543)
  CDS (2475)..(2543)
  CDS (2544)..(2552): adapter
gctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctcccaaacgcataaacttatcttcatagttgccactccaatttgctccttgaatctcctccacccaatacataatccactcctccatcacccacttcactactaaatcaaacttaactctgtttttctctctcctcctttcatttcttattcttccaatcatcgtactccgccatgaccaccgctgtcaccgccgctgtttctttcccctctaccaaaaccacctctctctccgcccgaagctcctccgtcatttcccctgacaaaatcagctacaaaaaggtgattcccaatttcactgtgttttttattaataatttgttattttgatgatgagatgattaatttgggtgctgcaggttcctttgtactacaggaatgtatctgcaactgggaaaatgggacccatcagggcccagatcgcctcttgctcttccatggcaatgattaattaacgaagagcaagagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgcctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaa

SEQ ID NO: 14394 - protein, 62 aa, Artificial sequence
  Synthetic Construct
MTTAVTAAVSFPSTKTTSLSARSSSVISPDKISYKKVPLYYRNVSATGKMGPIRAQIASCSS

SEQ ID NO: 14395 - DNA, 9043 bp, Artificial
  plasmid VC-MME489-1QCZ
agctttgggcggatcctctagaggacaatcagtaaattgaacggagaatattattcataaaaatacgatagtaacgggtgatatattcattagaatgaaccgaaaccggcggtaaggatctgagctacacatgctcaggttttttacaacgtgcacaacagaattgaaagcaaatatcatgcgatcataggcgtctcgcatatctcattaaagcagggcatgccggtcgagtcaaatctcggtgacgggcaggaccggacggggcggtaccggcaggctgaagtccagctgccagaaacccacgtcatgccagttcccgtgcttgaagccggccgcccgcagcatgccgcggggggcatatccgagcgcctcgtgcatgcgcacgctcgggtcgttgggcagcccgatgacagcgaccacgctcttgaagccctgtgcctccagggacttcagcaggtgggtgtagagcgtggagcccagtcccgtccgctggtggcggggggagacgtacacggtcgactcggccgtccagtcgtaggcgttgcgtgccttccaggggcccgcgtaggcgatgccggcgacctcgccgtccacctcggcgacgagccagggatagcgctcccgcagacggacgaggtcgtccgtccactcctgcggttcctgcggctcggtacggaagttgaccgtgcttgtctcgatgtagtggttgacgatggtgcagaccgccggcatgtccgcctcggtggcacggcggatgtcggccgggcgtcgttctgggctcatggtagactcgacggatccacgtgtggaagatatgaatttttttgagaaactagataagattaatgaatatcggtgttttggttttttcttgtggccgtctttgtttatattgagatttttcaaatcagtgcgcaagacgtgacgtaagtatccgagtcagtttttatttttctactaatttggtcgaatctagattcgacggtatcgataagctcgcggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtaggatccgcgagctggtcaatcccattgcttttgaagcagctcaacattgatctctttctcgatcgagggagatttttcaaatcagtgcgcaagacgtgacgtaagtatccgagtcagtttttatttttctactaatttggtcgtttatttcggcgtgtaggacatggcaaccgggcctgaatttcgcgggtattctgtttctattccaactttttcttgatccgcagccattaacgacttttgaatagatacgctgacacgccaagcctcgctagtcaaaagtgtaccaaacaacgctttacagcaagaacggaatgcgcgtgacgctcgcggtgacgccatttcgccttttcagaaatggataaatagccttgcttcctattatatcttcccaaattaccaatacattacactagcatctgaatttcataaccaatctcgatacaccaaatcgaagatctccctggaattccagctgaccaccatggcaattcccggggatcagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaatta

SEQ ID NO: 14396 - DNA, 132 bp, Escherichia coli
  CDS (1)..(132): transl_table=11
atgcacacgggcagcacgacgctgcccgatttttttgcagggatgagcgatgatttcacgccgccgatttttgcaggctactgccgcgacgatagccacgagctcaggtttcggttatatgcattactgtaa

SEQ ID NO: 14397 - protein, 43 aa, Escherichia coli
MHTGSTTLPDFFAGMSDDFTPPIFAGYCRDDSHELRFRLYALL

SEQ ID NO: 14398 - DNA, 126 bp, Desulfovibrio vulgaris subsp. vulgaris str. Hildenborough
  CDS (1)..(126): transl_table=11
atgaccgggacgaccccactgccggacgccttccaacacatcgcaccgggcatggccttgcaggtagccatttcccttgacttttccccaccagaggtttttctggcccgatgcaccagtttctaa

SEQ ID NO: 14399 - protein, 41 aa, Desulfovibrio vulgaris subsp. vulgaris str. Hildenborough
MTGTTPLPDAFQHIAPGMALQVAISLDFSPPEVFLARCTSF

SEQ ID NO: 14400 - DNA, 21 bp, Artificial sequence
  primer
atgcacacgggcagcacgacg

SEQ ID NO: 14401 - DNA, 27 bp, Artificial sequence
  primer
ttacagtaatgcatataaccgaaacct

SEQ ID NO: 14402 - DNA, 501 bp, ESCHERICHIA COLI
  CDS (1)..(501): transl_table=11
atgaatatgaagaccattgaagatgtatttattcacctgctttcagatacctacagcgcagaaaaacaattaacccgggcactggcaaaactcgcaagagcaacatcaaatgaaaaattaagtcaggcttttcatgcgcacctcgaggaaactcatggacagattgaacgtattgatcaagttgtggagtccgaatcgaacctgaaaattaagcgcatgaaatgtgtggcaatggaaggtcttattgaagaagctaatgaggtcatcgaaagtaccgagaaaaacgaagtgcgtgatgccgcactgattgccgcagcacagaaagtcgagcattatgagattgccagttacgggacattagcgacgctggctgaacaattaggttaccgtaaagcagcgaagcttctgaaagaaaccctggaagaagaaaaggccaccgacatcaaactgactgatctggccattaataacgtaaataagaaagccgaaaataaagcctaa

SEQ ID NO: 14403 - protein, 166 aa, ESCHERICHIA COLI
MNMKTIEDVFIHLLSDTYSAEKQLTRALAKLARATSNEKLSQAFHAHLEETHGQIERIDQVVESESNLKIKRMKCVAMEGLIEEANEVIESTEKNEVRDAALIAAAQKVEHYEIASYGTLATLAEQLGYRKAAKLLKETLEEEKATDIKLTDLAINNVNKKAENKA

SEQ ID NO: 14404 - DNA, 501 bp, Escherichia coli; 0157:H7
  CDS (1)..(501)
atgcaaattaaatctgttgaagatatcttcatccacttattatcggatacatacagcgctgagaaacaactaacaaaggcactgtctaaacttagtcgctctgcatatagtgataaattaaccgctgcttttcagtcacatcttgatgagacacatggtcaaattgaacgcatcgatcaggttgttgattctgaagatggtcttaaattgaaaagaattaagtgtgccgcaatggaaggacttatcgaagaggcgaatgaggtaattgaaagcactgataaaaatgaagtacgtgatgctgcattgattgctgcagcacaaaaagtagagcactatgaaattgccagttatggcactttggtaacactcgctgagcaattaggatataaaaaagcggctaaactcctgaaagaaacactggaagaggaaaaagctactgatgtcaaattaacagacctggcatttaataacgttaataaaaaagctcaggataactcctga

SEQ ID NO: 14405 - protein, 166 aa, Escherichia coli; 0157:H7
MQIKSVEDIFIHLLSDTYSAEKQLTKALSKLSRSAYSDKLTAAFQSHLDETHGQIERIDQVVDSEDGLKLKRIKCAAMEGLIEEANEVIESTDKNEVRDAALIAAAQKVEHYEIASYGTLVTLAEQLGYKKAAKLLKETLEEEKATDVKLTDLAFNNVNKKAQDNS

SEQ ID NO: 14406 - DNA, 483 bp, Mesorhizobium loti MAFF303099
  CDS (1)..(483): transl_table=11
atgctcgacgacctgtttcacgacacgctgaaggacatctatttcgccgaaaagaagatattggcgacactgccgaaaatggccaaggccgcgcaaagcgccgagctgaaggccgccttcgaaaagcaccgcaccgagaccgagggccacgtcgccaggctggagaaagtcttcggcgtgatcggcaagaagccggtcggcaagacctgtgcggccatcatgggcatcaccgaggaaggcgccgagatcatggaggagtacaagggatctcccgcgctcgatgccggtctgctggccgccgcgcaggcggtcgagcactacgagatctcacgctatggcacgctgaggacatgggccggtgaactcggcctgaacgaagccgtgacgcttctcgaagcaacgctgaaggaagagaaggccacggacgaggccctgaccaagatcgctgagacggcggtcaacgtagcagccgaagcagcataa

SEQ ID NO: 14407 - protein, 160 aa, Mesorhizobium loti MAFF303099
MLDDLFHDTLKDIYFAEKKILATLPKMAKAAQSAELKAAFEKHRTETEGHVARLEKVFGVIGKKPVGKTCAAIMGITEEGAEIMEEYKGSPALDAGLLAAAQAVEHYEISRYGTLRTWAGELGLNEAVTLLEATLKEEKATDEALTKIAETAVNVAAEAA

SEQ ID NO: 14408 - DNA, 507 bp, Mesorhizobium loti MAFF303099
  CDS (1)..(507): transl_table=11
atgggcttcttttcgaaggacatcaaaacgctggacgacctgttcgtgcacacattgcgcgacatctattacgcggaaaagcagatcgagaaggcgttgccgaagatgatcgacaaggccaccaacgcgcagctcaaagcaggcttcgaaaaacatcttgaacagaccaagggccatatcgaacgcgtggaagaggtgttcgagttgcatggcgtcaaggccaaggccatcgactgcccggccattgacggcatcctcgaggaagccgacgaggtgagcggcgacatcgccgacaaggaggtcctggacgccgccctgatcgcgtctgcgcaagcagtcgagcattacgaaatgacccgctacggcacgctgattgcatgggccaagcaactcggccgcagcgattgcgccaatgtactcgcgaagaatctcaaggaagagcaggcgaccgatcgcaagctcaccgagatggcggaaagcaagatcaatctccaggctgccgaatag

SEQ ID NO: 14409 - protein, 168 aa, Mesorhizobium loti MAFF303099
MGFFSKDIKTLDDLFVHTLRDIYYAEKQIEKALPKMIDKATNAQLKAGFEKHLEQTKGHIERVEEVFELHGVKAKAIDCPAIDGILEEADEVSGDIADKEVLDAALIASAQAVEHYEMTRYGTLIAWAKQLGRSDCANVLAKNLKEEQATDRKLTEMAESKINLQAAE

SEQ ID NO: 14410 - DNA, 528 bp, Mesorhizobium loti MAFF303099
  CDS (1)..(528): transl_table=11
atggcagctacgaagaaggcaaccgccaccaataaaggcctcgaggacatgtttgtcgaaggcctgaaagacatctactatgccgagaagaaaatcttgaaggcgctgccgaagatggcaaggggcgcggacgaccagcaggtcaccgccgccttcgaaaagcatcttgcggagaccgaaggccaagtcgagcggctggaagaagtatttgagattctcggcacggcggcccgaggcaaaacctgtccggccatcgacggcattctcgaggaaggctccgacattctcgaggagtacaaaggctcggtctcactggacgcaggtctggtaggcgccgcgcaggcggtcgaacactacgagatcgcgcgctatggcactctgattgcgtgggcgacatctcttggcagggatgatgtcgcggaactgctcaacgccaacctggaagaagaaaaagccaccgacgaagcactgacgtcgcttggcgaggcgggcgtaaacgaccgggctgccgaacagcaggccgcctga

SEQ ID NO: 14411 - protein, 175 aa, Mesorhizobium loti MAFF303099
MAATKKATATNKGLEDMFVEGLKDIYYAEKKILKALPKMARGADDQQVTAAFEKHLAETEGQVERLEEVFEILGTAARGKTCPAIDGILEEGSDILEEYKGSVSLDAGLVGAAQAVEHYEIARYGTLIAWATSLGRDDVAELLNANLEEEKATDEALTSLGEAGVNDRAAEQQAA

SEQ ID NO: 14412 - DNA, 507 bp, Escherichia coli O157:H7 EDL933
  CDS (1)..(507): transl_table=11
atgattatgcaaattaaatctgttgaagatatcttcatccacttattatcggatacatacagcgctgagaaacaactaacaaaggcactgtctaaacttagtcgctctgcatatagtgataaattaaccgctgcttttcagtcacatcttgatgagacacatggtcaaattgaacgcatcgatcaggttgttgattctgaagatggtcttaaattgaaaagaattaagtgtgccgcaatggaaggacttatcgaagaggcgaatgaggtaattgaaagcactgataaaaatgaagtacgtgatgctgcattgattgctgcagcacaaaaagtagagcactatgaaattgccagttatggcactttggtaacactcgctgagcaattaggatataaaaaagcggctaaactcctgaaagaaacactggaagaggaaaaagctactgatgtcaaattaacagacctggcatttaataacgttaataaaaaagctcaggataactcctga

SEQ ID NO: 14413 - protein, 168 aa, Escherichia coli O157:H7 EDL933
MIMQIKSVEDIFIHLLSDTYSAEKQLTKALSKLSRSAYSDKLTAAFQSHLDETHGQIERIDQVVDSEDGLKLKRIKCAAMEGLIEEANEVIESTDKNEVRDAALIAAAQKVEHYEIASYGTLVTLAEQLGYKKAAKLLKETLEEEKATDVKLTDLAFNNVNKKAQDNS

SEQ ID NO: 14414 - DNA, 501 bp, Escherichia coli O157:H7 EDL933
  CDS (1)..(501): transl_table=11
atgaatatgaagaccattgaagatgtatttattcacctgctttcagatacctacagcgcagaaaaacaattaacccgggcactggcaaaactcgcaagagcaacatcaaacgaaaaattaagtcaggcttttcatgcgcacctcgaggaaacacatggacagattgaacgtattgatcaagttgtggaatcagaatcgaatctgaaaattaagcgcatgaaatgtgtggcaatggaaggtcttattgaagaagctaatgaggtcatcgaaagtaccgagaaaaacgaagtgcgtgatgccgcactgattgccgcagcacagaaagtcgagcattatgagattgccagttacgggacattagcgacgctggctgaacaattaggttaccgtaaagcagcgaagcttctgaaagagaccctggaagaagaaaaggccaccgacatcaaactgactgatctggcccttaataacgtaaataagaaagccgaaaataaagcctga

SEQ ID NO: 14415 - protein, 166 aa, Escherichia coli O157:H7 EDL933
MNMKTIEDVFIHLLSDTYSAEKQLTRALAKLARATSNEKLSQAFHAHLEETHGQIERIDQVVESESNLKIKRMKCVAMEGLIEEANEVIESTEKNEVRDAALIAAAQKVEHYEIASYGTLATLAEQLGYRKAAKLLKETLEEEKATDIKLTDLALNNVNKKAENKA

SEQ ID NO: 14416 - DNA, 492 bp, Sinorhizobium meliloti 1021
  CDS (1)..(492): transl_table=11
atggccaaagaaaagacgctggacgacctcttccacgatacgctcaaggacatctattatgccgagcggaaaatcctgaaggctttgccgaagatggcacgcgccgcccaggcccctgagctcaaggccgcgttcgagaagcacaaggagcagaccgagacccatgtggagcggctgcagcaggtattcgaaatgatcggcaagcgcgcgcagggcaagacctgcgaggcgatcgagggcatcgtcgccgagggcgaggagatcatggacgaattcaagggcaccgccgcgctcgatgcgggcctcatctccgccgcgcaagcggtcgagcattatgaaatctcccgctacggcaccctgaagacctgggcaaagaccatcggtctcaaggatgcagtatcgctgctcgacgcgactttgaaggaagaagtcgtcaccgacgaggacctgacgaaactcgcgatggcccaagtgaacaagaaggccgcgtaa

SEQ ID NO: 14417 - protein, 163 aa, Sinorhizobium meliloti 1021
MAKEKTLDDLFHDTLKDIYYAERKILKALPKMARAAQAPELKAAFEKHKEQTETHVERLQQVFEMIGKRAQGKTCEAIEGIVAEGEEIMDEFKGTAALDAGLISAAQAVEHYEISRYGTLKTWAKTIGLKDAVSLLDATLKEEVVTDEDLTKLAMAQVNKKAA

SEQ ID NO: 14418 - DNA, 501 bp, Agrobacterium tumefaciens str. C58
  CDS (1)..(501): transl_table=11
atggctgagaagacattgaaagaccttttcctcgatacggtgaaggacatttatttcgccgagcggcagatcctgaaggcgctcccaaagatggcgcgggctgcgcagtcagcggatctgaaggccgccttcgaaaagcacagggacgagaccgaggttcatgtggagcgtttgcagaatgtctttgagtttctcggcaagccggcacgcggcaggacctgtgaggcgatccagggcattatcgcggaaggcgaggagatcatggaggagttcaaggggtcatcagcgctggatgctgggctgatttcatcagcccaggcggtagagcactacgagatcacccgttacggcactttgaagacctgggcggtcgaactgggcatgaaagaagcagccaagctgttcgaacagacgctgggcgaagagagcgcgacggatacggctctctcatcgcttgctcaggcaagggccaacatcaagggaaaatccaaagcagcgtga

SEQ ID NO: 14419 - protein, 166 aa, Agrobacterium tumefaciens str. C58
MAEKTLKDLFLDTVKDIYFAERQILKALPKMARAAQSADLKAAFEKHRDETEVHVERLQNVFEFLGKPARGRTCEAIQGIIAEGEEIMEEFKGSSALDAGLISSAQAVEHYEITRYGTLKTWAVELGMKEAAKLFEQTLGEESATDTALSSLAQARANIKGKSKAA

SEQ ID NO: 14420 - DNA, 504 bp, Salmonella typhimurium LT2
  CDS (1)..(504): transl_table=11
atgaatatcaaaaccgttgaagacctttttatccatctactttcagatacctatagtgcagaaaaacaattaaccaaggctcttcctaaacttgccagagccacgtccaatgaaaaattaagccaggcctttcaatctcatcttgaagaaacccagggtcagattgaacgtattgatcagatcgtcgaatctgaatctggcattaaactgaaaagaatgaaatgcgtcgctatggaagggctgattgaagaagccaatgaagtcatcgaaagtacggagaaaaacgaagtacgcgatgcagcgcttatcgccgcggcgcaaaaagtcgagcattacgaaatcgccagctacggcacgctagccaccctggccgagcagctcggctatagcaaagcattaaaactgctcaaagaaaccctcgacgaggaaaaacaaactgatttaaaacttaccgatttagcagtcagcaatgttaataaaagtgctgaacgcaaatcgaaataa

SEQ ID NO: 14421 - protein, 167 aa, Salmonella typhimurium LT2
MNIKTVEDLFIHLLSDTYSAEKQLTKALPKLARATSNEKLSQAFQSHLEETQGQIERIDQIVESESGIKLKRMKCVAMEGLIEEANEVIESTEKNEVRDAALIAAAQKVEHYEIASYGTLATLAEQLGYSKALKLLKETLDEEKQTDLKLTDLAVSNVNKSAERKSK

SEQ ID NO: 14422 - DNA, 507 bp, Xanthomonas axonopodis pv. citri str. 306
  CDS (1)..(507): transl_table=11
atggcgatcaagactgtcgaagaccttttcatccacgagctgtcggacatctacagcgccgagaagcagctgaccaagtcgctgccgcgtcttgcgcgtgcggccaccgagccgaaactgaagcaggccttcgaaactcatctggaagaaacccaaggccagatcgaacgcatcgaccaggtcgtcgaggttctgggcatcaagctcaagcgcatcaaatgcgctgcgatggaaggcctggtggaggagagccgcgaggtcatcgatgaaatcgaggccggcccggtgcgcgatgcggcactgatcggcggtgcgcagaaggtggagcattacgaaatcgcctcgtacggcaccattgccgccatagccaagcaactcggttatgccgatgcattgccgctgctgctcgccacgctggaagaagaaaaggccaccgacgaaaagctgaccctgctcgccgagcaaggcggcaaccagaaggcatccaaggccagcaaggccgcctga

SEQ ID NO: 14423 - protein, 168 aa, Xanthomonas axonopodis pv. citri str. 306
MAIKTVEDLFIHELSDIYSAEKQLTKSLPRLARAATEPKLKQAFETHLEETQGQIERIDQVVEVLGIKLKRIKCAAMEGLVEESREVIDEIEAGPVRDAALIGGAQKVEHYEIASYGTIAAIAKQLGYADALPLLLATLEEEKATDEKLTLLAEQGGNQKASKASKAA

SEQ ID NO: 14424 - DNA, 504 bp, Escherichia coli CFT073
  CDS (1)..(504): transl_table=11
atgtcgacacacaacactcatattaatgaaactattcacctgctttcagatacatacagcgcagaaaaacaattaacccgggcgctggcaaaactcgcaagagcaacatcaaacgaaaaattaagtcaggcttttcatgcgcacctcgaggaaacacatggacagattgaacgtattgatcaaattgtggaatcagaatcgaatctgaaaattaagcgcatgaaatgtgtggcaatggaaggtcttattgaagaagctgatgaggtcatcgaaagtaccgagaaaaacgaagtgcgtgatgccgcactgattgccgcagcacagaaagtcgagcattatgagattgccagttacgggacattagcgacgctggctgaacaattaggttatcgtaaagcagcgaagcttctgaaagataccctggaagaagaaaaggccaccgacatcaaattgactgatctggcccttaataacgtaaataagaaagccgaaaataaagcctga

SEQ ID NO: 14425 - protein, 167 aa, Escherichia coli CFT073
MSTHNTHINETIHLLSDTYSAEKQLTRALAKLARATSNEKLSQAFHAHLEETHGQIERIDQIVESESNLKIKRMKCVAMEGLIEEADEVIESTEKNEVRDAALIAAAQKVEHYEIASYGTLATLAEQLGYRKAAKLLKDTLEEEKATDIKLTDLALNNVNKKAENKA

SEQ ID NO: 14426 - DNA, 507 bp, Bradyrhizobium japonicum USDA 110
  CDS (1)..(507): transl_table=11
atgggactgttcacaaaagacatcaagaccatgaacgacctgttcgtgcatcagctccaggacatctactatgccgagcagcagctcaccaaggcgctgccgaagatggccgacaaggccaccgacccgcagctgaaaaagggctttttgacgcacctcgaggaaacgaagcagcacgtcaagcggctcgaggaagtgttcaagatgcacggcgcacaggtgaaggcggtcgactgcccggcgatcgacggcatcatcgaggaggccgacgagaccgccggcgaggtcgccgacaaggcggtgctggacgctgcgctgatcaatgcggcgcaggccgccgagcattacgagatcgtgcgttacggcagcctgatcgcctgggccaaacagctcggccggagcgactgcgccgccgtgctcgccaagacgctcgaggaggagaaggcgaccgacaagaagctcacggcgctcgccgagagcaaggtgaatctgcgcgcggcgagctag

SEQ ID NO: 14427 - protein, 168 aa, Bradyrhizobium japonicum USDA 110
MGLFTKDIKTMNDLFVHQLQDIYYAEQQLTKALPKMADKATDPQLKKGFLTHLEETKQHVKRLEEVFKMHGAQVKAVDCPAIDGIIEEADETAGEVADKAVLDAALINAAQAAEHYEIVRYGSLIAWAKQLGRSDCAAVLAKTLEEEKATDKKLTALAESKVNLRAAS

SEQ ID NO: 14428 - DNA, 498 bp, Bradyrhizobium japonicum USDA 110
  CDS (1)..(498): transl_table=11
atgttgagcgacctgtttctggagacgctgaaggacatctattacgccgagaacaagatcatcaagacgctgccgaagatggcgaaggcggctcactccaagcagctgtccgcggccttcaacaagcatctgcgcgagacgcagggccaggtcaaacgccttgaccagatcttcaagatgctgggcaagcccgcgcgcggcaagccctgcgaggcgatcaacggcatcaccgacgagggcgccgagatcatgaaggatttcaagaacgcccctgccctcgacgccggcctgctcgccgcggcgcaagccgtcgagcactacgagatctcccgctacggcacgctgcgcacctgggccgaggagctcggcatgccggacgccgccaggctgctccaggcgacgctcgatgaggaagaggcgaccgatcacaccctgaccgagctcgccacctccgtgatcaacctcgaagcggaagaagaataccgcgccgccgcctga

SEQ ID NO: 14429 - protein, 165 aa, Bradyrhizobium japonicum USDA 110
MLSDLFLETLKDIYYAENKIIKTLPKMAKAAHSKQLSAAFNKHLRETQGQVKRLDQIFKMLGKPARGKPCEAINGITDEGAEIMKDFKNAPALDAGLLAAAQAVEHYEISRYGTLRTWAEELGMPDAARLLQATLDEEEATDHTLTELATSVINLEAEEEYRAAA

SEQ ID NO: 14430 - DNA, 516 bp, Bradyrhizobium japonicum USDA 110
  CDS (1)..(516): transl_table=11
atgggattcttcacaaaagacctcaaaacaatggatgacttgctcctacacggcttgcaggacatttattactccgagcagcagatcataaaggcgctcccgaaaatgatcgagaaggcgaccaaccgcgatctggtggcgggcctcaagaaccatttggaagaaactaacaagcagatcgagcgtctcgaaaaggcttttgagaagctgggcaaggggccgagcggcacgcaatgtcccgctatcgacggtctgatcaaagaagcgaacgagacggctggcgagatcgaagataagacggtgcttgacgcggcgattgtcgcgaacgcgcaggccgtcgagcattacgagatatgccgttacggtacgctgattgcctgggcggaagaacttggccacgacgatatcgtgcgatttttgaccacaaatctgaacgaagagaaggcggcgaacaccaagctcaataccgtcgcactgcgcaagggcgtcaacaagaaagcgtccaccgccgcgtga

SEQ ID NO: 14431 - protein, 171 aa, Bradyrhizobium japonicum USDA 110
MGFFTKDLKTMDDLLLHGLQDIYYSEQQIIKALPKMIEKATNRDLVAGLKNHLEETNKQIERLEKAFEKLGKGPSGTQCPAIDGLIKEANETAGEIEDKTVLDAAIVANAQAVEHYEICRYGTLIAWAEELGHDDIVRFLTTNLNEEKAANTKLNTVALRKGVNKKASTAA

SEQ ID NO: 14432 - DNA, 507 bp, Bordetella bronchiseptica RB50
  CDS (1)..(507): transl_table=11
atgactcgcaaaaccctgcaggaactgttcatccacgaactatcggatatctacagcgccgagaaacaactgaccaaggcgctgcccaagatggcgcgctcggccagcgatcccaagctggccgaggcgttctccgcccatctggaggaaacgcgcggacaggtcgagcgcatcgaccagatcgtcgaaggctccgacctgcgcctcaagcgcatgaagtgcgccgccatggaggggctggtcgaggagggcaaggaggtgatggacgagatcgaaccagggccggtgctcgacgcggcgctgatcgctgccgcgcagaaggtggagcattacgaaattgccagctacggcacgctttgcactttcgccaagcaactgggcgagaccaaggcgctggcgctgctcaaggaaacgctggccgaggaaaaggccaccgacgagaagctgagcatgctggccctgaagcaggtcaacgccgacgcggccgccgccggcaaggcgaagtag

SEQ ID NO: 14433 - protein, 168 aa, Bordetella bronchiseptica RB50
MTRKTLQELFIHELSDIYSAEKQLTKALPKMARSASDPKLAEAFSAHLEETRGQVERIDQIVEGSDLRLKRMKCAAMEGLVEEGKEVMDEIEPGPVLDAALIAAAQKVEHYEIASYGTLCTFAKQLGETKALALLKETLAEEKATDEKLSMLALKQVNADAAAAGKAK

SEQ ID NO: 14434 - DNA, 510 bp, Rhodopseudomonas palustris CGA009
  CDS (1)..(510): transl_table=11
atgggatttttcagcagggacattcagacgatggaggacctgctgctgcacggcctccgcgacatctactacgccgaacagcagataaccaaggcgctgccgaagatgatcgagcaggccaccaatcgcgatctgtcgcagggcctaacatcgcatctggaagagacccagaagcagatcgaacggctcgaccaagtgttcaagaagctcggtcagaagccctcgggggtgaactgcccggcgatcgacggcctcatcaaggaagccgatgagaccgccggcgagatcgccgacaagaccgtgctggacgctgcgatcgtcgccaatgcgcaggcagtcgagcactacgagatcgcccgctacggcaccctgatcgcctgggccgaggagctcggccacgacgacatcgtccgtttcctcaccaccaatctcaacgaggaaaaggccgccaacaccaagctcaacaccgtggcgctccgtaagggcgtcaatcgtaaagctgcaagctga

SEQ ID NO: 14435 - protein, 169 aa, Rhodopseudomonas palustris CGA009
MGFFSRDIQTMEDLLLHGLRDIYYAEQQITKALPKMIEQATNRDLSQGLTSHLEETQKQIERLDQVFKKLGQKPSGVNCPAIDGLIKEADETAGEIADKTVLDAAIVANAQAVEHYEIARYGTLIAWAEELGHDDIVRFLTTNLNEEKAANTKLNTVALRKGVNRKAAS

SEQ ID NO: 14436 - DNA, 501 bp, Rhodopseudomonas palustris CGA009
  CDS (1)..(501): transl_table=11
atggttgccaccaaagacaaggacctcaacgacctgttcctcgacactttgaaggacatctatttcgccgagaagcagatcctgaaggcgttgccgaagatggcgaaggccgcaacctccgacaaactgcgtgccgcgttcgagaagcatcgtgacgaaaccgaaggccagatcgagcgactggagcaggtgttcgaactgctcgagaagccggcccgcggcaagacctgcgacgccatcctcggcatcatcgacgagggcaaggagatcatggacgagtacaagggcaccgaggcgctcgatgccggcctgctcgccgctgcccaggcggtcgaacactacgagatctcccgctacggcaccctgaagcagtgggcgacccagctcggcatgaaggacgctgccaagctgatcgaccagacgctgcagcaggaaaagaccaccgatcagaccctgaccaagctcgccgagagctcgatcaacgttgcagccgcggcctga

SEQ ID NO: 14437 - protein, 166 aa, Rhodopseudomonas palustris CGA009
MVATKDKDLNDLFLDTLKDIYFAEKQILKALPKMAKAATSDKLRAAFEKHRDETEGQIERLEQVFELLEKPARGKTCDAILGIIDEGKEIMDEYKGTEALDAGLLAAAQAVEHYEISRYGTLKQWATQLGMKDAAKLIDQTLQQEKTTDQTLTKLAESSINVAAAA

SEQ ID NO: 14438 - DNA, 507 bp, Rhodopseudomonas palustris CGA009
  CDS (1)..(507): transl_table=11
atgggacttttcaccaaagacatcaagacgatggatgacctgttcgtgcatcaattgcaggatatctactacgccgagaagcagcttctgaaggcgatcccgaagatggctgacaaggcttcggatccgatgctgaaacagggcttcctgacccatctggacgagaccaagggccacgtgaagcggctggagcaggtgttcgagatgcatggcgtccagcccaaggcgatcgactgcccggcgatcgacggcatcatcgaggaagccgacgaaaccgcgggcgaagtcgaggacaagaaggtgctcgacgccgcgctgatcaacgccgcgcaggcggtggagcactacgagatcgtgcgctacggcagcctggtatcatgggccaagctgctcggccgcaacgactgcgcggcggtgctgcagaagacgctcgacgaggagaaggccaccgataagaagctcaacaccctcgccgagagccaggtcaatctgcgcgcggccggctga

SEQ ID NO: 14439 - protein, 168 aa, Rhodopseudomonas palustris CGA009
MGLFTKDIKTMDDLFVHQLQDIYYAEKQLLKAIPKMADKASDPMLKQGFLTHLDETKGHVKRLEQVFEMHGVQPKAIDCPAIDGIIEEADETAGEVEDKKVLDAALINAAQAVEHYEIVRYGSLVSWAKLLGRNDCAAVLQKTLDEEKATDKKLNTLAESQVNLRAAG

SEQ ID NO: 14440 - DNA, 495 bp, Bradyrhizobium sp. ORS278
  CDS (1)..(495): transl_table=11
atggctgcagacaaagacctcaacgaactcttcctcgatacgctgaaggacatctactacgccgagaagcagatcctgaagaatctgccgaagatggccaaggcggcgcagtcgcagaagctgtcagcggcgtttgagaagcaccaggaggagaccgagggccagatcgagcgcctggagcagatcttcgagctgctcggcaagcccgcgcgcggcaagcgttgcgatgcgatcgagggcatcctcgacgagggcaaggagatcatgacggagtacaagggcacgtcggcgctcgatgccggcctgctggctgcggcgcaggccgtcgagcactacgagatctcgcgctacggcaccttgaagtcctgggccaacaagctcgaactcaagcaggccgtcaagctgctcgaccagaccctgaacgaggagaagaagaccgacgatctcctgaccaaggtcgccgagagcgaggtcaactacgaggcggctgcctga

SEQ ID NO: 14441 - protein, 164 aa, Bradyrhizobium sp. ORS278
MAADKDLNELFLDTLKDIYYAEKQILKNLPKMAKAAQSQKLSAAFEKHQEETEGQIERLEQIFELLGKPARGKRCDAIEGILDEGKEIMTEYKGTSALDAGLLAAAQAVEHYEISRYGTLKSWANKLELKQAVKLLDQTLNEEKKTDDLLTKVAESEVNYEAAA

SEQ ID NO: 14442 - DNA, 507 bp, Bradyrhizobium sp. ORS278
  CDS (1)..(507): transl_table=11
atgggactgttcaccaaagacatcaagacgatgaatgacctgttcgtgcaccagctgcaggacatctattacgccgagaaccagctcatcaaggcgctgcccaagatggccgacaaggcgaccgatcagcagctgaagcagggttttctgacccatctcgaggaaacccgcacgcatgtgaagcggctcgagcaggtgttcgagatgcagggcatcgcgcccaaggcagtcgactgcccggcgatcgacggcatcatcgaggaggccgaggaggtcgccggcgaggtggccgacaagaccgtgctcgatgcggcgctgatcaatgccggccaagccgccgagcactacgagatcacccgctatggcagcctgatcgcgtgggccaagcagctcggccgcagcgactgcgccgctctgctgcagaagacgctcgacgaggagaaggcgaccgacatgaagctgaccaagctcgccgaaaccagcgtcaacctgcgcgccgcgagctga

SEQ ID NO: 14443 - protein, 168 aa, Bradyrhizobium sp. ORS278
MGLFTKDIKTMNDLFVHQLQDIYYAENQLIKALPKMADKATDQQLKQGFLTHLEETRTHVKRLEQVFEMQGIAPKAVDCPAIDGIIEEAEEVAGEVADKTVLDAALINAGQAAEHYEITRYGSLIAWAKQLGRSDCAALLQKTLDEEKATDMKLTKLAETSVNLRAAS

SEQ ID NO: 14444 - DNA, 495 bp, Klebsiella pneumoniae subsp. pneumoniae MGH 78578
  CDS (1)..(495): transl_table=11
atgaatatgaaaagcattgaagatgtatttattcacctgctctcagatacctacagcgcagagaaacaattaacccgcgggctggctaaactagccagagcggcgtccagtgaaaaactcagcgcggcgttcaatgctcatcttgaagaaacccagggccagatcgaacgtatcgaccagattattgaacaggaatccaacctgaaaatcaaacgcatgaaatgcgtggccatggaaggattaatcgaagaagctaatgaagtcgttgagagcacggaaaaaaatgaggtacgtgatgctgcattaattgccgctgcgcaaaaggtcgagcattacgaaattgccagttacggtactctggtcaccctggcagagcagttgggctataaaaaagcagccaaactgcttgccgaaaccctggaagaagaaaaacaaaccgatgtgaaattaaccgatctggcggtaggtaatattaataagaaagcggaaaaataa

SEQ ID NO: 14445 - protein, 164 aa, Klebsiella pneumoniae subsp. pneumoniae MGH 78578
MNMKSIEDVFIHLLSDTYSAEKQLTRGLAKLARAASSEKLSAAFNAHLEETQGQIERIDQIIEQESNLKIKRMKCVAMEGLIEEANEVVESTEKNEVRDAALIAAAQKVEHYEIASYGTLVTLAEQLGYKKAAKLLAETLEEEKQTDVKLTDLAVGNINKKAEK

SEQ ID NO: 14446 - DNA, 504 bp, Xanthobacter autotrophicus Py2
  CDS (1)..(504): transl_table=11
atgggcttcttttccaaagacatccattcgctcgacgatctcttcgtgcacacgctgcgcgacatctattacgccgaaaagcgcattctgaaggcgctgcccaccatggtggagaaagcctcgagcgcgaccctgcgccaggcattccagtcccacctgggcgagaccgaggggcatgtgaggcgcctggaggaggtgttccgcatgcatggcgtcgaggccagcccggtgaaatgcccggccatcgacggcatcatcgccgaggccgaggaggtggcgtccgaggtggccgatcccgaggtgctggatgcggcgctggctgccgcggcgcaggcggtcgagcattacgagatcacccgctacggcaccctcgtcgcctgggccaagcgtctcggccgcaatgactgcgccaccctgctccagcgcaccctcgacgaggagaaggcgaccgacgccaagctcaccggcctcgccgagacccaggtcaacatgcgcgcggcctga

SEQ ID NO: 14447 - protein, 167 aa, Xanthobacter autotrophicus Py2
MGFFSKDIHSLDDLFVHTLRDIYYAEKRILKALPTMVEKASSATLRQAFQSHLGETEGHVRRLEEVFRMHGVEASPVKCPAIDGIIAEAEEVASEVADPEVLDAALAAAAQAVEHYEITRYGTLVAWAKRLGRNDCATLLQRTLDEEKATDAKLTGLAETQVNMRAA

SEQ ID NO: 14448 - DNA, 525 bp, Candidatus Protochlamydia amoebophila UWE25
  CDS (1)..(525)
atgaaacaacaacaaactggcttacataaattatttattgatgaattgcaagacatgtatagtgcggaaaagcaaattacagaggccatgcccaaattaactaaatcagcttctctacctgaattaaaagaagcactcatggatcatttgaaagaaacaaaaactcaagtagctcgtctggaacaaatctttgagataatgggtttaccagccaaagaaaaactttgtaaagcgatggaaggaatattgaaagaaggagaagagctcacaaaaattatggaaaaatcaactacattagatgcagctattatcagtgctgcacaaaaagttgagcattatgaaattgcttcttatggaacgctgtgtagctttgctaaacatcttcagttgaatagccaaatccgagatcttcttaaagatacacttgatgaagaaaaggctgcggataaaaaattaacaaagcttggagaaggctcattttttacatcgggagtcaatgctgaagccgcagaagcaaaaaaataa

SEQ ID NO: 14449 - protein, 174 aa, Candidatus Protochlamydia amoebophila UWE25
MKQQQTGLHKLFIDELQDMYSAEKQITEAMPKLTKSASLPELKEALMDHLKETKTQVARLEQIFEIMGLPAKEKLCKAMEGILKEGEELTKIMEKSTTLDAAIISAAQKVEHYEIASYGTLCSFAKHLQLNSQIRDLLKDTLDEEKAADKKLTKLGEGSFFTSGVNAEAAEAKK

SEQ ID NO: 14450 - DNA, 498 bp, Pseudomonas syringae pv. syringae B728a
  CDS (1)..(498): transl_table=11
atgactcgcacgacgatagaagatttgttcattcacgaactttcagacgtttacagcgctgaaaagcaaattaccaaagcactcccgcgtctggcacgcgcttcgaccaatccactgctggcagaagccttcaaggctcatcttgaagaaactcagggtcagatcgatcgtatcgatgaattggtggaaggcgctggtctgaagctgaaacgcatgaagtgcgcggccatggaaggtctgatcgaagaaagcaaggaattgctggaagagatcgaaaaaggtgcagtgctcgatgccgcgttgatcggcgcatgccagaaggtcgaacattacgagatcgccagttacggcacactcatcgcaatggccagacatttaaatatgaaagaggcagccgctctattgagtgccacgttggcggaagaaaaaggcgcagacgaaaagctcacggagatcgccgaacagggcggaacccaggcggccacttcgaaaaagtaa

SEQ ID NO: 14451 - protein, 165 aa, Pseudomonas syringae pv. syringae B728a
MTRTTIEDLFIHELSDVYSAEKQITKALPRLARASTNPLLAEAFKAHLEETQGQIDRIDELVEGAGLKLKRMKCAAMEGLIEESKELLEEIEKGAVLDAALIGACQKVEHYEIASYGTLIAMARHLNMKEAAALLSATLAEEKGADEKLTEIAEQGGTQAATSKK

SEQ ID NO: 14452 - DNA, 498 bp, Pseudomonas fluorescens Pf-5
  CDS (1)..(498): transl_table=11
atggccagaaaaactgttgaagatctcttcatccatgagctttccgatgtttacagcgcggagaaacaaattaccaaggcgttgcctcgtttggcgcgtgccgcgactaatccacttctcgcggaggccttcacgtcccatctcgaagaaacccagggccaaatcgagcgaatcgatcagttggtcgagttgaccggttttaagctcaaacgcatgaagtgcgttgccatggagggcttggtcgaagaatccaaggagctattggaagaaatcgacaaaggtgcggtactggacgcagccctcattggcgctgcacagaaagtcgaacattacgaaatcgccagctacggcacgctcatcgcgatggccaagcacctgaagcttgaggatgcagccacgctgctggcggcgacattggcagaagaaaaaggcgccgatgaaaaactgtcgaagattgccgagcaaggcggtaatcaggcagcaacgcttgaaaagtaa

SEQ ID NO: 14453 - protein, 165 aa, Pseudomonas fluorescens Pf-5
MARKTVEDLFIHELSDVYSAEKQITKALPRLARAATNPLLAEAFTSHLEETQGQIERIDQLVELTGFKLKRMKCVAMEGLVEESKELLEEIDKGAVLDAALIGAAQKVEHYEIASYGTLIAMAKHLKLEDAATLLAATLAEEKGADEKLSKIAEQGGNQAATLEK

SEQ ID NO: 14454 - DNA, 495 bp, Thermobifida fusca YX
  CDS (1)..(495): transl_table=11
atgaaactggaaaccccgagagacctgttcgtccacgaaatgtcggccatgcgcaccggtgaggcggtgatcgccgacatgctcgacgagatgtccggtatggtcgccgacgagaacgtcgccgacatgctccgccaccaccagcaggaaacccagcagcagatcgccaacctcgagcagtgtttccgggcgatcggtgcgacaccgcagcgagtcccctgcgcggcgatcgaagcgctgcgccaagagttccgagagttcgccggaatgaacccgtcaccgcaagtgctgacgatgttcgcgctcggcggggccctcaaggtcgaacactatgagatcgccgcctaccggggacttgttggcaaagccatgctcatgggggagaccacctgcatccaactgctggaaaccaaccttctgcaagaagaagagaccgcaggcaaactggagcgcttcacccacgagatgggccgccgaatgctcgccaccgtgtga

SEQ ID NO: 14455 - protein, 164 aa, Thermobifida fusca YX
MKLETPRDLFVHEMSAMRTGEAVIADMLDEMSGMVADENVADMLRHHQQETQQQIANLEQCFRAIGATPQRVPCAAIEALRQEFREFAGMNPSPQVLTMFALGGALKVEHYEIAAYRGLVGKAMLMGETTCIQLLETNLLQEEETAGKLERFTHEMGRRMLATV

SEQ ID NO: 14456 - DNA, 510 bp, Rhodobacter sphaeroides 2.4.1
  CDS (1)..(510): transl_table=11
atggagacggacatgaagacgaaggaactcgacacggcctttcacgacatgctcaaggacgtctattacgccgagcggcagatcctgaaggccctgcccaagatggcccgcgccgccaagtccgagcagctcaaggaggccttcaagacccaccgcgaagagaccgagggccagaaggagcgcctcgagaaggtgttcgagcttctgggcaagcgggcgcagggcaagacctgtccggccatcgacgggatcatcgaggaaggctccgaggtgatggacgaatacaaggacagcccggccctcgatgccgcgctgctcgcggcggcgcaggcggtcgaacattacgagatggcccgctacgggacgctcgtggcctgggcccggaccctcgggatggaggatgcggcgaagcttctggcggaaacgctggaagaagagaagaagaccgatggcctgctgaacgatctcgccggcgccgaagtgaaccagagcgccctcgcagcggcctga

SEQ ID NO: 14457 - protein, 169 aa, Rhodobacter sphaeroides 2.4.1
METDMKTKELDTAFHDMLKDVYYAERQILKALPKMARAAKSEQLKEAFKTHREETEGQKERLEKVFELLGKRAQGKTCPAIDGIIEEGSEVMDEYKDSPALDAALLAAAQAVEHYEMARYGTLVAWARTLGMEDAAKLLAETLEEEKKTDGLLNDLAGAEVNQSALAAA

SEQ ID NO: 14458 - DNA, 507 bp, Rhodospirillum rubrum ATCC 11170
  CDS (1)..(507): transl_table=11
atgggactgttcatcaaagatatcggcagtctggatgaccttttcgtccatgcgctggaagatatctactacgccgagcaaaaaatcctgacggcccttcccaagatgatcgagaaggccaccgacagcgcgctccgcgaaggcttcgagacgcatttgcacgaaacgcaaaagcaggtggaacgcctggagcaagtcttcgccaatcatggcgtcgagccgaaggcgacgaaatgcgcggcgatcgatggcatcatcgacgaggccgaggatttggccggtgaaatccgtgacaccgaggtcctcgacgcggcgctgatctcggcggcccaggcggtcgagcattacgagatcacccgctacggcaccctggtcgcctgggcgaaacgtctgggggccgatgactgcgcccagttgcttgaagaaaccctggccgaggagaaggcgaccgacgaaaagctctcggccctcgcctattccgcgatcaacctgcgggcggcagagtag

SEQ ID NO: 14459 - protein, 168 aa, Rhodospirillum rubrum ATCC 11170
MGLFIKDIGSLDDLFVHALEDIYYAEQKILTALPKMIEKATDSALREGFETHLHETQKQVERLEQVFANHGVEPKATKCAAIDGIIDEAEDLAGEIRDTEVLDAALISAAQAVEHYEITRYGTLVAWAKRLGADDCAQLLEETLAEEKATDEKLSALAYSAINLRAAE

SEQ ID NO: 14460 - DNA, 498 bp, Rhodospirillum rubrum ATCC 11170
  CDS (1)..(498): transl_table=11
atggctgagaagaccctggataagcttttctatgacaccctcaaggatatttattatgccgagaggaagatcctgaaggcgttgccgaagatggcgcggggcgccgattcggcggaactgcgggccgccttcgaaaaacaccatcaggaaaccgaagggcagatcgaacgccttcaaatggccttcgaattgttcggcaagcgcgcccagggcaaaacctgcgacgcgatcgaaggcatcctgagcgagggcgaggaaatccttgacgcgttcaagggcgagccggcggtcgatgccggtctgatcgcctcggcccaggcggtcgagcattacgagatcgcccgctatggcacgctcaagcgctgggccgaggtgctcggcatgcccgagatcgccaagcttcttgaccagacgcttcaagaagagatcaagaccgacgccgatctgaccaagctggccgataaagtcgccaattcggcggccctgaaggcggcctga

SEQ ID NO: 14461 - protein, 165 aa, Rhodospirillum rubrum ATCC 11170
MAEKTLDKLFYDTLKDIYYAERKILKALPKMARGADSAELRAAFEKHHQETEGQIERLQMAFELFGKRAQGKTCDAIEGILSEGEEILDAFKGEPAVDAGLIASAQAVEHYEIARYGTLKRWAEVLGMPEIAKLLDQTLQEEIKTDADLTKLADKVANSAALKAA

SEQ ID NO: 14462 - DNA, 507 bp, Acidobacteria bacterium Ellin345
  CDS (1)..(507): transl_table=11
atggccctgttttccatgaaagttgagaaccttgaagagctgttcattgagcagctccgtgacctttacgacggcgagcagcagatcacaaaggcgttgccgaagctgattgagaaagcgaccgattcacgactgcaagatgcgttgcaagatcatctcgaagttactcgtgagcagattcgtcgcctcgagcagatcttccagatcctgggcgaagacgccgatggcgaaacctgcaaaggcatgaaaggcgtgattgccgaaggtgatgacgtcgttggcgatgcggacgacaaagcggtgcgcgatgcggtcatcatagcgtctgcgcagcgagtggaacattacgagatcgctggctatggaacggtgcgaacgtatgcgaatttgctcggccaagcgcagatcgcacagctcctggaacagacactgcaggaagagaaggaagcagaccagacacttaaccagatcgctgaaagcgtaaatatcgacgcaaaagccgcgtaa

SEQ ID NO: 14463 - protein, 168 aa, Acidobacteria bacterium Ellin345
MALFSMKVENLEELFIEQLRDLYDGEQQITKALPKLIEKATDSRLQDALQDHLEVTREQIRRLEQIFQILGEDADGETCKGMKGVIAEGDDVVGDADDKAVRDAVIIASAQRVEHYEIAGYGTVRTYANLLGQAQIAQLLEQTLQEEKEADQTLNQIAESVNIDAKAA

SEQ ID NO: 14464 - DNA, 594 bp, Acidobacteria bacterium Ellin345
  CDS (1)..(594): transl_table=11
atgcagaccgcacacgagatgtttatccatgaactgcaagacctgctcgatgccgagcagcaactcgtcgaggccctcggaaaacaggccgaggagtcctcgcgacccgatcttcagaaggctttccagagccaccaggcccagactgaaaagcaggtagagcgcctgcgccagtgtttcgaatccattggtgaagaagccgaagaagtggaatgcgacggcattcgcggccttctcaaagagcatgacggcttcatggaagaagaagatccggcagaggaccttatcgacatcttcaataccgtggccgccgcgaaggtggagagctatgagatccaggcataccagtcggtcatccgcctggccgacctcatgggccacaagaaggcttcaaagttgctcaaccagagcttgaaagaagaacagcagacgctgaagaagatggaagccttcagcaagaagctgaagccgcagaacctcggcatggaagaggaagagggcgaggagatggagaacgaaggtgacgaaacggccgaaactcgcaagggttcgcgttccgccggctctcgttcccgtcgtggccgcgccgcgtaa

SEQ ID NO: 14465 - protein, 197 aa, Acidobacteria bacterium Ellin345
MQTAHEMFIHELQDLLDAEQQLVEALGKQAEESSRPDLQKAFQSHQAQTEKQVERLRQCFESIGEEAEEVECDGIRGLLKEHDGFMEEEDPAEDLIDIFNTVAAAKVESYEIQAYQSVIRLADLMGHKKASKLLNQSLKEEQQTLKKMEAFSKKLKPQNLGMEEEEGEEMENEGDETAETRKGSRSAGSRSRRGRAA

SEQ ID NO: 14466 - DNA, 495 bp, Mesorhizobium sp. BNC1
  CDS (1)..(495): transl_table=11
atgcccgcccagaaccggacgcttgagaatttgatgctggagacgctgaaggacatctatcacgctgaaaagcaagtgctgaggacgctgccgaagatgaccaaggcggcgaaatccgatgaactgaaaaaggcgctggaaaagcatcggcaggaaaccgagggccagatcgaacgcctcgagaaggttttcgaggcgatggatcgggcgccgcgcggaaagccttgcgaggcgatgcagggactcgttgccgaggggcaggagatcatggaagagttctccgactccgatgccctggacgcaggcctggtttcagcgaaccaatcgatcgagcattacgagatttcccgctatggcacacttcgcacttgggcacgacagctcgggatggaggatgcagcaaaactcttcgagcaaaatctggaggaggagaagaggactgacgaactcctcaccaagctcgccgagtcgcaagccaacaagaaagcggcgtga

SEQ ID NO: 14467 - protein, 164 aa, Mesorhizobium sp. BNC1
MPAQNRTLENLMLETLKDIYHAEKQVLRTLPKMTKAAKSDELKKALEKHRQETEGQIERLEKVFEAMDRAPRGKPCEAMQGLVAEGQEIMEEFSDSDALDAGLVSANQSIEHYEISRYGTLRTWARQLGMEDAAKLFEQNLEEEKRTDELLTKLAESQANKKAA

SEQ ID NO: 14468 - DNA, 507 bp, Mesorhizobium sp. BNC1
  CDS (1)..(507): transl_table=11
atgggtctgttttcgaacgacatcaggagcatggatgatctgttcatgcacacgctcaaggacatctactacgccgaaaaccagatcacgaaggccttgcccaagatgatggagaaggccagcaaccagcagctgaagcaaggatttgagcagcatctgagggaaacagaaggccacattcgcaatctggagcaggtcttccagatgatgaatatggagccgaagggcgtcgattgcccggccatcgacggcatcattgaggagtcggacgagattgccggcgaggtggaggacccgaaggtgctcgatgccgcgctgatcgcggctgctcaggccgtggagcattatgagatcacccgttatggcacgctcatcacctgggcacaggagcttggcatgtcggaatgcgcggatatcctgaagcgcaaccttgccgaggagaaggcgaccgacgagaagcttaccgaacttgccgaaagccgaatcaatcttgccgcagtgcaataa

SEQ ID NO: 14469 - protein, 168 aa, Mesorhizobium sp. BNC1
MGLFSNDIRSMDDLFMHTLKDIYYAENQITKALPKMMEKASNQQLKQGFEQHLRETEGHIRNLEQVFQMMNMEPKGVDCPAIDGIIEESDEIAGEVEDPKVLDAALIAAAQAVEHYEITRYGTLITWAQELGMSECADILKRNLAEEKATDEKLTELAESRINLAAVQ

SEQ ID NO: 14470 - DNA, 588 bp, Cytophaga hutchinsonii ATCC 33406
  CDS (1)..(588): transl_table=11
atggaaaagaaaacaacaactgcaaacggtgcaaaaaaaactgctccgaaaactaccaaacaaaaatcaacaaacagtacaggttccatgcaggaatcacagttacaaaaattatttgaagacgaattaaaggatatttactgggctgaaaaagcattgaccaaagccattcctaaaatggttaaacatgctacttcacaagaattgatccaggccctggaatcacatttggaagaaacacagcaacatgttacacgtttggaacaggtgtttgaaatcatcggaaaaaatgctgtagccaaaaaatgcgaagcaatggcaggcctgattgaagaagcaacacagatcatggaagaatgtgaagaaggtgctatgtgtgatgctggtatcatttctgcggcacagaaagtagaacattacgaaatcgcgagctatggtacattgtgtcagtttgcagcaacattaggactttcagaagcaaaagaaattcttggttcgactttgaatgaagaaaaaacagcagatgaaaaactatctgaagttgcagaaagtgcagtgaatattgaagcagcacacgaagaagcataa

SEQ ID NO: 14471 - protein, 195 aa, Cytophaga hutchinsonii ATCC 33406
MEKKTTTANGAKKTAPKTTKQKSTNSTGSMQESQLQKLFEDELKDIYWAEKALTKAIPKMVKHATSQELIQALESHLEETQQHVTRLEQVFEIIGKNAVAKKCEAMAGLIEEATQIMEECEEGAMCDAGIISAAQKVEHYEIASYGTLCQFAATLGLSEAKEILGSTLNEEKTADEKLSEVAESAVNIEAAHEEA

SEQ ID NO: 14472 - DNA, 498 bp, Rhizobium leguminosarum bv. viciae 3841
  CDS (1)..(498): transl_table=11
atggccaaggaaaagacgttggaagatctcttctacgacacgctgaaggacatctacttcgccgaacggcagatattgcgcgccctgccgaagatggcgcgcgccgcccaatcccccgaattgaagaagggcttcgaaaaacaccgtgaggaaaccgaaggccaggtcgagcgcctgcagcaggttttcgagctgatcggcaaacgcgcccagggcaagacttgcgaggcgatccagggcattatcgccgagggcgaggaaatcatggaggaattcaagggcacggtggctctcgatgccggcctgatttccgctgcccaggccgtcgagcattatgaaatcgcccgttacggcacgctgaagacctgggccgcgaccctcggtctcaaggaggtcgtcggcctgctcgaccagacgctgcaacaggaaacggccaccgacaagaccctctcccagctagccaccacggcagcaaaccagaaggcaaaggctgcctga

SEQ ID NO: 14473 - protein, 165 aa, Rhizobium leguminosarum bv. viciae 3841
MAKEKTLEDLFYDTLKDIYFAERQILRALPKMARAAQSPELKKGFEKHREETEGQVERLQQVFELIGKRAQGKTCEAIQGIIAEGEEIMEEFKGTVALDAGLISAAQAVEHYEIARYGTLKTWAATLGLKEVVGLLDQTLQQETATDKTLSQLATTAANQKAKAA

SEQ ID NO: 14474 - DNA, 516 bp, Solibacter usitatus Ellin6076
  CDS (1)..(516): transl_table=11
ttgaaaaaccataagagattcgaagacctcttcgaagaggaaatcgaagccctgtacgacgctgaaatgcggatcgtggacgcgcttcccaggatgatggcggctgcttctaccaaggaactggctattgccttcgcgtctcacctggaagaaacccggcgccatgtcacacgcctggaagacattttccagatcatgggcgaggagccgcgcggacgtacgagcgacgccataagcggcttcctctccgacgtttcggcgctcatcgatggaatgcgcgaatcggcgacgcttgatctcgccctcgtcaccgcagcccggatgatcgaacactgggaaatggtggcatacgagagcgcggcggctatcgcagggatgttgggccagttgtccgcgtcagacctgctcgaaaagactctcgaggaggagggcgccgccgatgacactctcgccgccattgcagcctcactgctcggtggagatatcggcgcgcaggatctggacgtcgccagttga

SEQ ID NO: 14475 - protein, 171 aa, Solibacter usitatus Ellin6076
MKNHKRFEDLFEEEIEALYDAEMRIVDALPRMMAAASTKELAIAFASHLEETRRHVTRLEDIFQIMGEEPRGRTSDAISGFLSDVSALIDGMRESATLDLALVTAARMIEHWEMVAYESAAAIAGMLGQLSASDLLEKTLEEEGAADDTLAAIAASLLGGDIGAQDLDVAS

SEQ ID NO: 14476 - DNA, 528 bp, Solibacter usitatus Ellin6076
  CDS (1)..(528): transl_table=11
atgacaacctccctcaagggacttttcgaagaggaaattcgagacctctacgatgccgagaaacagctggtgaaggcgcttccgaaaatggccaaggccgccgaatcggaagaactgcgcagcggctttgaagaacacctggaagcaaccaagggccatgtcaccaggctcgaacaggttttcgagtcgatcggcgccaagccgaaaggcaaggcttgcgaagccatgaaaggcctggtggccgagggccaggaagtcatcaatagcagtcaggagggtgaactccacgatattcaactgatcggagccgccaagcgggtggagcattacgagatggcggcctaccagacggtgatcaaactggccgaagcactgggcaacatggatgccgcggagctgcttcgcgaaaccctctcggaagaagaagagaccgacgagaagctggatacgatgtgcgacgaccttctcgaaactgccggcacgatgggcggcgaggatgatgctcccaaagcccggcgcgccgggtaa

SEQ ID NO: 14477 - protein, 175 aa, Solibacter usitatus Ellin6076
MTTSLKGLFEEEIRDLYDAEKQLVKALPKMAKAAESEELRSGFEEHLEATKGHVTRLEQVFESIGAKPKGKACEAMKGLVAEGQEVINSSQEGELHDIQLIGAAKRVEHYEMAAYQTVIKLAEALGNMDAAELLRETLSEEEETDEKLDTMCDDLLETAGTMGGEDDAPKARRAG

SEQ ID NO: 14478 - DNA, 594 bp, Solibacter usitatus Ellin6076
  CDS (1)..(594): transl_table=11
atgccacaacttaaggaactactagtcgaacaactgcaggacctgcttcatgcggagagccaactcacggacgcattgccgcaaatggcagaggccgcgaatcacccgaagctgaaggaggcgtttgaaaagcacctggtccagacccagggtcacgtcgaacgcttgcacaagatattcgaggttctgggggagaaagcccagccaaaaacatgcaaggccatgatcggtctgatcgaggaaggcaaagaaacgatcgaggaaggcgcggaaaagaagcccctggccgctgatttggctctgatcggcgcagcgcagcgagtggaacattacgaaatcgcggcttacggcaccgcgaaagctctggcgcgccagatagggcttctcgaggccgcgcgactcctatcgcacactttgggcgaagaggagagcaccgattttctcttgactgcaatttccgatccgctgcttcagcaggcggccatccaggacggcggcattccaataaacctggaagctgtagaaaggcagggccccgcgcgcgccacgagaaaagcggagaagcccgaaaagatggcgagccggggacgttag

SEQ ID NO: 14479 - protein, 197 aa, Solibacter usitatus Ellin6076
MPQLKELLVEQLQDLLHAESQLTDALPQMAEAANHPKLKEAFEKHLVQTQGHVERLHKIFEVLGEKAQPKTCKAMIGLIEEGKETIEEGAEKKPLAADLALIGAAQRVEHYEIAAYGTAKALARQIGLLEAARLLSHTLGEEESTDFLLTAISDPLLQQAAIQDGGIPINLEAVERQGPARATRKAEKPEKMASRGR

SEQ ID NO: 14480 - DNA, 495 bp, Magnetospirillum magnetotacticum MS-1
  CDS (1)..(495): transl_table=11
atgtcagcaccgagcatcctcaaggaagtctatcttgacgagatgaaggacctttggtcggcgaacgaccagatgataaggacagtcaaggagttgggcggccatgtctccgacccgaagctcaagcagatgcttgagcactcggtcggcggcatccagaagcacaccgacatcctcaaggacctgatccagcagaacggcggcgaggccgagccggagcactgcaagggcatggagggtctcgtgaccgaggcgaagaagcacggcatccaggaggcgccgagcgacggcaagctgcgcgacgtggagatcatcgcgcagtaccagcgcatgtcacactacgggctggccggcttcggctcggcggcggcctacgccaaggccctcggccgctccgaggacgagcagaagctgaagcaggcggtggcggagatctacaagggcgacgagatcgcgagccagctcgccgagagcctggagcaagtcgcggcctga

SEQ ID NO: 14481 - protein, 164 aa, Magnetospirillum magnetotacticum MS-1
MSAPSILKEVYLDEMKDLWSANDQMIRTVKELGGHVSDPKLKQMLEHSVGGIQKHTDILKDLIQQNGGEAEPEHCKGMEGLVTEAKKHGIQEAPSDGKLRDVEIIAQYQRMSHYGLAGFGSAAAYAKALGRSEDEQKLKQAVAEIYKGDEIASQLAESLEQVAA

SEQ ID NO: 14482 - DNA, 504 bp, Magnetospirillum magnetotacticum MS-1
  CDS (1)..(504): transl_table=11
atgggtctgttcacgaaggatatcaaatctctcgacgacctcttcgtgcacacgttgcaggacgtctattacgccgagaaccagatcgccaaagccttgccgaagatgatcgagaaggccacggccgccgaattgcgccagggattcgagacgcatctgcgcgagaccgaggggcagatcgagcggctggagcgagttttcgcgatgcacgggcacaagccgaaggcggtggattgcccagccatcgacggcatcgtccgggaagccgacgacaccgccggtgagatcgccgaccgggaggtgatggatgcggccctgctcgcggcggcgcaggcggtggagcattacgagatcgcccgctacggcaccctggtcgcctgggcgaaacggctcggtcgcgacgattgcgccgccgtgctgcagcaatccctcgacgaggagaaggccaccgaccgcaagctcacggcgctcgccgagagcaaggtgaaccagaaggctgcctga

SEQ ID NO: 14483 - protein, 167 aa, Magnetospirillum magnetotacticum MS-1
MGLFTKDIKSLDDLFVHTLQDVYYAENQIAKALPKMIEKATAAELRQGFETHLRETEGQIERLERVFAMHGHKPKAVDCPAIDGIVREADDTAGEIADREVMDAALLAAAQAVEHYEIARYGTLVAWAKRLGRDDCAAVLQQSLDEEKATDRKLTALAESKVNQKAA

SEQ ID NO: 14484 - DNA, 501 bp, Oceanicola batsensis HTCC2597
  CDS (1)..(501): transl_table=11
atggcactgttctcgaaggacatcacctcgaaacacgatctcttcctgcatacgatgcgggacatctactatgcggagaagcagatcgagaaggccctgcccaagatgatctcgaaggcctcggacgggccgcttaaggaaggcttcgaatcccacctcgaggaaacccacgggcacgtgaaacggctcgaggatgcgttcaaggcgctcggcgaagaggccaagggtgtcgaatgcccggccatcgacggcatcatcaaggaggccgaggaagtcgccggcgaggtcggggaccaggaggtgctcgacgcggctctggcagcggcggcgcaggccgtggagcattacgagatgtcgcgctacggcacgctcatcgcgtggtcgaaggaaatgggccacgacgaatgcacccggctcttcgaatccacgctggaagaggaaaaggccgccgacaagaaactgaccgaagtggccgaaagccggctgaacaaggctgcttga

SEQ ID NO: 14485 - protein, 166 aa, Oceanicola batsensis HTCC2597
MALFSKDITSKHDLFLHTMRDIYYAEKQIEKALPKMISKASDGPLKEGFESHLEETHGHVKRLEDAFKALGEEAKGVECPAIDGIIKEAEEVAGEVGDQEVLDAALAAAAQAVEHYEMSRYGTLIAWSKEMGHDECTRLFESTLEEEKAADKKLTEVAESRLNKAA

SEQ ID NO: 14486 - DNA, 486 bp, Oceanicola batsensis HTCC2597
  CDS (1)..(486): transl_table=11
atgcaaaccgacagtctgaaagcgctctatttcaccgaactgcaggaggccgcctcgttcgaggcacagttcgccgaggcgctgccccgtttcgccgagaaagccaacgatccgtccctgcgcgaggtcctgtccgacgacatgcccgcggcgcgccggcacgcgcaacagctgagcggtctgctcgagatgcacgaggtcgccgaccgcggccacactgacggctcgatgcgggcgatcctgcgcgaagccctcgactgggtggaagacatcgccgacccggcagtgcgggatgcggcgctgatcgcgtcggtccagcgcatcctgcactatggcatggcggtccacggctcgctcgccggctgggcacgacagctggaccttgccgaccgggaaaccctggaagcggcggtcgaggaagcgcgcggtgccgatgcccggctgaccgagatcgcgcaaggcaaggtcaacgccgaggcggcctga

SEQ ID NO: 14487 - protein, 161 aa, Oceanicola batsensis HTCC2597
MQTDSLKALYFTELQEAASFEAQFAEALPRFAEKANDPSLREVLSDDMPAARRHAQQLSGLLEMHEVADRGHTDGSMRAILREALDWVEDIADPAVRDAALIASVQRILHYGMAVHGSLAGWARQLDLADRETLEAAVEEARGADARLTEIAQGKVNAEAA

SEQ ID NO: 14488 - DNA, 501 bp, Erythrobacter sp. NAP1
  CDS (1)..(501): transl_table=11
atgactatcagcaccctcaaagacctctatatcgaccagcttcaggacatctacagcgccgacaagcaatcgctcgacgcgacgaaaaagctgcacgataaggcgacctcggaagagctgcgcgccgcgcttgaagatggcacctgcggcatttcgaagggcatggaaaaggtcaaaggcctgatccagaaccatgacgccaaccccaatggcgaacactgcaagggcatggaaggcctcgtaaacgaagccaaggcccacgcaatcaacgccgacatcgacgacaaggacgtcctcgatgcgtcgatcatcacccagtatcagcgcatgacccactatggtctcgccggctacggaaccgccgtcgcattcgcaaagcgcctcggcctcgaagacgactccaaggtcctgcaggaatgcctcgacaacacctatgatggcgaccgccgcatgacctcgatcgcgaccggcgaagtgaacgctgaagcattggccgcgtga

SEQ ID NO: 14489 - protein, 166 aa, Erythrobacter sp. NAP1
MTISTLKDLYIDQLQDIYSADKQSLDATKKLHDKATSEELRAALEDGTCGISKGMEKVKGLIQNHDANPNGEHCKGMEGLVNEAKAHAINADIDDKDVLDASIITQYQRMTHYGLAGYGTAVAFAKRLGLEDDSKVLQECLDNTYDGDRRMTSIATGEVNAEALAA

SEQ ID NO: 14490 - DNA, 513 bp, Erythrobacter sp. SD-21
  CDS (1)..(513): transl_table=11
atggagtttctgatgtcagcacctgccaatctttccgactgttataccgaagaactcgccgatctgtggtcggccaacgatcagatgacgaaagtcgttcgcgatctggctgatgcagctcaggatcgaagtctgactgaccgtttaagtagggcagcggatgggatcgagaagcatacgaagacgctcaagtcccttctcaaagagtgcggtgaaagcgaaaaggagcactgcaagggcatggagggtctggtcaaagaagcccgcaagcatgccctggaagccgatatcgaagacgcggacgttcgcgatgtgctgatcgtcgcgcaatatcagcgcatgtgtcactacggcattgcaggcttcggaacggcgaaggcgttcgccgaagcgctcggcaataaggaccacgctaccaagctcgatacgatcacgtccgaaatctacgatgcggacgagaacatgaccgatctagcggagcgcagcatcaacctcgaagcgaaaaaaggctaa

SEQ ID NO: 14491 - protein, 170 aa, Erythrobacter sp. SD-21
MEFLMSAPANLSDCYTEELADLWSANDQMTKVVRDLADAAQDRSLTDRLSRAADGIEKHTKTLKSLLKECGESEKEHCKGMEGLVKEARKHALEADIEDADVRDVLIVAQYQRMCHYGIAGFGTAKAFAEALGNKDHATKLDTITSEIYDADENMTDLAERSINLEAKKG

SEQ ID NO: 14492 - DNA, 26 bp, Artificial sequence
  primer
atgaatatgaagaccattgaagatgt

SEQ ID NO: 14493 - DNA, 28 bp, Artificial sequence
  primer
ttaggctttattttcggctttcttattt

SEQ ID NO: 14494 - protein, 175 aa, Artificial sequence
  consensus sequence
  Variant (2)..(4): Xaa in position 2 to 4 is any amino acid
  Variant (6)..(6): Xaa in position 6 is any amino acid
  Variant (8)..(8): Xaa in position 8 is any amino acid
  Variant (10)..(10): Xaa in position 10 is any amino acid
  Variant (13)..(17): Xaa in position 13 to 17 is any amino acid
  Variant (20)..(25): Xaa in position 20 to 25 is any amino acid
  Variant (27)..(30): Xaa in position 27 to 30 is any amino acid
  Variant (32)..(37): Xaa in position 32 to 37 is any amino acid
  Variant (39)..(41): Xaa in position 39 to 41 is any amino acid
  Variant (43)..(47): Xaa in position 43 to 47 is any amino acid
  Variant (49)..(63): Xaa in position 49 to 63 is any amino acid
  Variant (64)..(65): Xaa in position 64 to 65 is any or no amino acid
  Variant (67)..(67): Xaa in position 67 is any amino acid
  Variant (69)..(70): Xaa in position 69 to 70 is any amino acid
  Variant (72)..(74): Xaa in position 72 to 74 is any amino acid
  Variant (76)..(89): Xaa in position 76 to 89 is any amino acid
  Variant (90)..(91): Xaa in position 90 to 91 is any or no amino acid
  Variant (94)..(98): Xaa in position 94 to 98 is any amino acid
  Variant (101)..(101): Xaa in position 101 is any amino acid
  Variant (108)..(109): Xaa in position 108 to 109 is any amino acid
  Variant (114)..(116): Xaa in position 114 to 116 is any amino acid
  Variant (118)..(119): Xaa in position 118 to 119 is any amino acid
  Variant (122)..(127): Xaa in position 122 to 127 is any amino acid
  Variant (128)..(129): Xaa in position 128 to 129 is any or no amino acid
  Variant (131)..(133): Xaa in position 131 to 133 is any amino acid
  Variant (135)..(135): Xaa in position 135 is any amino acid
  Variant (138)..(140): Xaa in position 138 to 140 is any amino acid
  Variant (142)..(143): Xaa in position 142 to 143 is any amino acid
  Variant (145)..(147): Xaa in position 145 to 147 is any amino acid
  Variant (149)..(151): Xaa in position 149 to 151 is any amino acid
  Variant (152)..(171): Xaa in position 152 to 171 is any or no amino acid
  Variant (173)..(174): Xaa in position 173 to 174 is any amino acid
FXXXLXDXYXAEXXXXXALXXXXXXAXXXXLXXXXXXHXXXTXXXXXRXXXXXXXXXXXXXXXXXCXAXXGXXXEXXXXXXXXXXXXXXXXDAXXXXXAQXVEHYEIXXYGTLXXXAXXLGXXXXXXXXLXXXLXEEXXXDXXLXXXAXXXXXXXXXXXXXXXXXXXXXXXNXXA

SEQ ID NO: 14495 - protein, 40 aa, Artificial sequence
  protein pattern
  Variant (3)..(5): Xaa in position 3 to 5 is any amino acid
  Variant (6)..(7): Xaa in position 6 to 7 is any or no amino acid
  Variant (9)..(10): Xaa in position 9 to 10 is any or no amino acid
  Variant (12)..(12): Xaa in position 12 is any amino acid
  Variant (13)..(13): Xaa in position 13 is Ala, Ile or Val
  Variant (18)..(18): Xaa in position 18 is Ile or Met
  Variant (19)..(19): Xaa in position 19 is Ala, Cys, Ser, Thr or Val
  Variant (20)..(20): Xaa in position 20 is any amino acid
  Variant (23)..(23): Xaa in position 23 is Ser or Thr
  Variant (24)..(24): Xaa in position 24 is Ile, Leu or Val
  Variant (25)..(27): Xaa in position 25 to 27 is any amino acid
  Variant (28)..(28): Xaa in position 28 is Ala or Ser
  Variant (29)..(30): Xaa in position 29 to 30 is any amino acid
  Variant (31)..(31): Xaa in position 31 is Ile, Leu or Met
  Variant (32)..(39): Xaa in position 32 to 39 is any amino acid
  Variant (40)..(40): Xaa in position 40 is Phe, Ile or Leu
DAXXXXXAXXQXXEHYEXXXYGXXXXXXXXXXXXXXXXXX

SEQ ID NO: 14496 - protein, 18 aa, Artificial sequence
  protein pattern
  Variant (2)..(2): Xaa in position 2 is any or no amino acid
  Variant (4)..(6): Xaa in position 4 to 6 is any amino acid
  Variant (7)..(7): Xaa in position 7 is Ile or Val
  Variant (8)..(8): Xaa in position 8 is any amino acid
  Variant (10)..(10): Xaa in position 10 is Ile, Leu or Val
  Variant (11)..(11): Xaa in position 11 is Asp, Glu or Gln
  Variant (12)..(12): Xaa in position 12 is any amino acid
  Variant (13)..(13): Xaa in position 13 is Ala, Ile, Leu or Val
  Variant (14)..(14): Xaa in position 14 is Phe, Ile or Val
  Variant (15)..(17): Xaa in position 15 to 17 is any amino acid
  Variant (18)..(18): Xaa in position 18 is Asp, Glu, Gly or Ser
EXTXXXXXRXXXXXXXXX

SEQ ID NO: 14497 - DNA, 657 bp, Escherichia coli
  CDS (1)..(657): transl_table=11
atgggaacagccgcagaacaccacagagagggaattatgagccagtttttttatattcatcctgataacccacagcaacgtctgatcaaccaggcggtggagatcgtgcgtaaaggcggggtgattgtttatccaactgattccggctatgcgctcggctgtaaaattgaagataaaaacgcgatggagcgtatttgtcgtattcgccagctgccggacggtcacaactttaccctgatgtgtcgcgatctttctgaactctcgacctattcatttgttgataacgttgcgtttcgtttaatgaaaaacaacacgccgggcaactataccttcatcctgaaggggacgaaggaagtgccacgccgtctgttgcaggaaaaacgcaaaaccatcggtatgcgtgtgccttctaaccctatcgctcaggcgttacttgaagcattgggcgaaccgatgctttccacttcgctaatgctgccaggcagcgaatttaccgaatcggacccggaagaaattaaagatcgtctggaaaaacaggtagatttgattattcacggcggctatctcgggcagaaaccgacaacggttattgatcttaccgatgatacgccggtcgtggtgcgtgaaggcgtaggtgatgtgaagcctttcttataa

SEQ ID NO: 14498 - protein, 218 aa, Escherichia coli
MGTAAEHHREGIMSQFFYIHPDNPQQRLINQAVEIVRKGGVIVYPTDSGYALGCKIEDKNAMERICRIRQLPDGHNFTLMCRDLSELSTYSFVDNVAFRLMKNNTPGNYTFILKGTKEVPRRLLQEKRKTIGMRVPSNPIAQALLEALGEPMLSTSLMLPGSEFTESDPEEIKDRLEKQVDLIIHGGYLGQKPTTVIDLTDDTPVVVREGVGDVKPFL

SEQ ID NO: 14499 - DNA, 621 bp, Xenorhabdus bovienii
  CDS (1)..(621): transl_table=11
atgagccagtttttttatatccatcctgacaatccacaatcccgcttaattgggcagagtgtagatgtgttaaaaaagggtggagttgtcatttatcctactgattcaggctacgctattgggtgctgccttgaaaacaaggatgccatgacacacatatgccgtattcgccaattggatggacgccacaattttaccctgatgtgccgtgatctttctgaaattgcggcttatgcgcatgtggataatcaggcattcagattgataaaaaataatacgcccggtaattacacctttattttacaggcgacgaaagacgttccccgtcgtttgatgaacgaaaagcgtaaaaccatcggcctgcgtgtcccttccaatcctattgctttggcattactggaaggaatgagagagccactgatgtcatgtagcttgattttacccggaaatgattttgcggaatctgatccagaagagattaaggatgtgctgggtaaacaggttgatttaattattcacggtggttatcttgggcagcaaccgacgacggtaattgatttgaccggagattttccggaggttctgcgcgaaggtgaaggggatgtaacaccttttctatag

SEQ ID NO: 14500 - protein, 206 aa, Xenorhabdus bovienii
VSQFFYIHPDNPQSRLIGQSVDVLKKGGVVIYPTDSGYAIGCCLENKDAMTHICRIRQLDGRHNFTLMCRDLSEIAAYAHVDNQAFRLIKNNTPGNYTFILQATKDVPRRLMNEKRKTIGLRVPSNPIALALLEGMREPLMSCSLILPGNDFAESDPEEIKDVLGKQVDLIIHGGYLGQQPTTVIDLTGDFPEVLREGEGDVTPFL

SEQ ID NO: 14501 - DNA, 672 bp, Synechococcus sp. PCC 7002
  CDS (1)..(672): transl_table=11
atggctaattattattcactccacccgaaaaatccccaacaacgggatttagaggcgatcgcccaacaactccgggctggggccgtgatgttatatccaacagatacagtgtacgccattggttgtgatctcaccgcaaagcaagccgtgcaaaaagtgcgccaactcaagcgcctcgccaacgataaacccctcactttcctctgctcatccctgtcgaatatttctgaatatgccctcgtcagtgacgaagcttaccggattatgaaacgggcaattcctggcccctataccttcttacttcccgccacaaaacaggtgccgaagctggtgatgagccccaaacgccgcagcaccgggattcgtgtccctgaccatgcgatctgtcagggtttactccaggcccttggcaatccgattatttccacctcggcccacttgcccgacgaagatggtgaaccttttacccttggccttgaaaaagcgcgcctctttgatgccctagagccccttgtggatatcatcatcgacagtgacagcgagcccggcaccaaaacttcaacgattctcgacttttgcgatcgccaaccgaccctcatccgtaaaggcctcggctgggatgccctcgaaggctggcttgacgtggtcgacctctccgacgccacacaataa

SEQ ID NO: 14502 - protein, 223 aa, Synechococcus sp. PCC 7002
MANYYSLHPKNPQQRDLEAIAQQLRAGAVMLYPTDTVYAIGCDLTAKQAVQKVRQLKRLANDKPLTFLCSSLSNISEYALVSDEAYRIMKRAIPGPYTFLLPATKQVPKLVMSPKRRSTGIRVPDHAICQGLLQALGNPIISTSAHLPDEDGEPFTLGLEKARLFDALEPLVDIIIDSDSEPGTKTSTILDFCDRQPTLIRKGLGWDALEGWLDVVDLSDATQ

SEQ ID NO: 14503 - DNA, 621 bp, Vibrio cholerae O1 biovar eltor str. N16961
  CDS (1)..(621): transl_table=11
atgagccagtttttttatgttcatcctgagaaccctcaaacccgcctgatcaaccaagcggtcgcgattattcgcaatggtggggtagtggtttacccaaccgattctggttacgcactgggctgccagcttgaaaataagcacgggatggaacgcatttgtcaaattcgccgtctcgacgataagcacaattttacgctgttgtgccgcgatttgtctgagctttcgctgtatgcgcgtgtggataacacggcgtttcgtttgttgaaaaacaatacaccgggaccttacaccttcatattcaaaggaaccaaagaggttccgcgccgtctgatgaatgagaagcgaaagaccataggtatccgggtaccgaataacaaaattgccttggatctactggaagcgctcggcgagccactcatgtcgacatcgctgatcctgccaggcaacgattttactgagtctgatcccgaggaaattcgcgatcgcttagagcacgcggtggatgtgatcctcaatggtggctatttaggtcagcaacccacgacagtgattgattttagcgacgatgaagtggtagtggcgcgtgtcggagccggtgatccgaccccgtttcagtag

SEQ ID NO: 14504 - protein, 206 aa, Vibrio cholerae O1 biovar eltor str. N16961
MSQFFYVHPENPQTRLINQAVAIIRNGGVVVYPTDSGYALGCQLENKHGMERICQIRRLDDKHNFTLLCRDLSELSLYARVDNTAFRLLKNNTPGPYTFIFKGTKEVPRRLMNEKRKTIGIRVPNNKIALDLLEALGEPLMSTSLILPGNDFTESDPEEIRDRLEHAVDVILNGGYLGQQPTTVIDFSDDEVVVARVGAGDPTPFQ

SEQ ID NO: 14505 - DNA, 624 bp, Pasteurella multocida subsp. multocida str. Pm70
  CDS (1)..(624): transl_table=11
atgagtcaatttttttatattcatccagaaaatccacaagtacgtttaattaatcaagcggtggagattttgcgtgctggtggtgtgattgtttatccgactgattctggttatgcactgggatgcatgatcggtgataaacatgcgatggatcgcattgtacagatccgccaattacctgaagggcataattttacacttgtctgcagtgacttatcagaattatctacctattcattggtgaataatatggcgtaccgcttgattaaaaataatacgccaggtcgttatacttttattttaacggcaacaaaagaattaccacgacgtttaatgacgtcaaaacgtaaaactattgggattcgtgtacctgacaatcaaattgcattagcgttattaagcaccttaggggagccgattttatcttgttccttgatgttaccgggtgaggaaaatgttacccagtcagatcctgaagagattcgagatcgtttagaaaaacaggtggatttgattattcatggtggttatctcggcgcagaaccaacaactgtggttgatttaacaaacgataccccgataattatccgcgaagggagtgggtctaccgcgccttttgtctaa

SEQ ID NO: 14506 - protein, 207 aa, Pasteurella multocida subsp. multocida str. Pm70
MSQFFYIHPENPQVRLINQAVEILRAGGVIVYPTDSGYALGCMIGDKHAMDRIVQIRQLPEGHNFTLVCSDLSELSTYSLVNNMAYRLIKNNTPGRYTFILTATKELPRRLMTSKRKTIGIRVPDNQIALALLSTLGEPILSCSLMLPGEENVTQSDPEEIRDRLEKQVDLIIHGGYLGAEPTTVVDLTNDTPIIIREGSGSTAPFV

SEQ ID NO: 14507 - DNA, 642 bp, Neisseria meningitidis MC58
  CDS (1)..(642): transl_table=11
atgacgataaggaaacaaaccatggcacagtttttcgctattcatcccgacaatccccaagaacgcctcatcaagcaggcggttgaaatcgtcaataaaggcggcgtggtcgtttatccgaccgattcctgttatgccttgggctgcaaactcggcgataaggcggcgatggaacgcatactctccatccgcaaaatcgatttgaaacaccacctgaccctgatgtgcgcagatttgagcgagttgggcacatacgccaaagtcgacaacgtacagtttcgtcagcttaaagccgccacacccgggccttatacttttattttacaggcgacgaaggatgtgccggcgcgcacgctgcacccgaaacgcaaaaccatcgggctgcgtattcccgataatgccattgcacaagccctgctgggggaattgggcgagccgcttttaagctgcaccctgatgctgcccgaagacggcgaaccattgaccgatccttatgaaatccgcgagcgtttggaacacgccgtcgatttggtgattgacggcggctggtgcggaaccgagccgaccaccgtcgtcgatatgaccgacggcacggaattggtgcgccaaggttgcggcgatacggcggtgttcggtttgtag

SEQ ID NO: 14508 - protein, 213 aa, Neisseria meningitidis MC58
MTIRKQTMAQFFAIHPDNPQERLIKQAVEIVNKGGVVVYPTDSCYALGCKLGDKAAMERILSIRKIDLKHHLTLMCADLSELGTYAKVDNVQFRQLKAATPGPYTFILQATKDVPARTLHPKRKTIGLRIPDNAIAQALLGELGEPLLSCTLMLPEDGEPLTDPYEIRERLEHAVDLVIDGGWCGTEPTTVVDMTDGTELVRQGCGDTAVFGL

SEQ ID NO: 14509 - DNA, 621 bp, Neisseria meningitidis Z2491
  CDS (1)..(621): transl_table=11
atggcacagtttttcgctattcatcccgacaacccccaagaacgcctcatcaagcaggcggtcgaaatcgtcaataaaggcggcgtggtcgtttatccgaccgattcctgttatgccttgggttgcaaactcggcgataaggcggcgatggaacgcatactctccatccgcaaaatcgatttgaaacaccacctgaccctgatgtgcgccgatttgagcgagttgggcacgtacgccaaaattgacaacgtacagtttcgtcagcttaaagccgccacacccgggccttatacttttattttacaggcgacgaaggatgtgccggcgcgcacgctgcacccgaaacgcaaaaccatcgggctgcgtattcccgataatgccattgcacaagccctgctgggggaattgggcgaaccgcttttaagctgcaccctgatgctgcccgaagacggcgaaccattgaccgatccttatgaaatccgcgagtgtttggaacacgccgtcgatttggtgattgacggcggctggtgcggaaccgagccgaccaccgtcgtcgatatgaccgacggcacggaattggtgcgccaaggttgcggcgatacggcggtgttcggtttgtag

SEQ ID NO: 14510 - protein, 206 aa, Neisseria meningitidis Z2491
MAQFFAIHPDNPQERLIKQAVEIVNKGGVVVYPTDSCYALGCKLGDKAAMERILSIRKIDLKHHLTLMCADLSELGTYAKIDNVQFRQLKAATPGPYTFILQATKDVPARTLHPKRKTIGLRIPDNAIAQALLGELGEPLLSCTLMLPEDGEPLTDPYEIRECLEHAVDLVIDGGWCGTEPTTVVDMTDGTELVRQGCGDTAVFGL

SEQ ID NO: 14511 - DNA, 621 bp, Salmonella typhimurium LT2
  CDS (1)..(621): transl_table=11
atgagccagtttttttatatccatccggataacccacagcaacggctgattaatcaggccgtcgacattgtgcgtaaaggcggtgttattgtttatccaaccgattccggctatgcccttggttgtaaaattgaagacaaaggcgcaatggagcgcatttgccgcatccgtcatctgccggacggccacaacttcacgctgatgtgccgcgatttgtccgagttgtcgacctactcctacgtcgacaacgtggcatttcgtctgatgaaaaacaatacgccgggtaattacacctttatcctgaaggggacaaaagaggtgccgcgccgtctgttgcaggaaaagcgtaaaactatcggcctgcgcgtaccgtcaaacccgattgcgttggcgttattggatacgctgggcgaaccgatgctctcgacgtcgttgatgctgcctggcagcgattttaccgagtcggacccggaggagattaaagatcggctggagaagcaggtggatctgatcatccacggtggttacctcggtcaacagcctaccacggtaatcgatttgaccaatgactccccggtggtgctgcgcgaaggcgtcggcgacgttacacctttcttataa

SEQ ID NO: 14512 - protein, 206 aa, Salmonella typhimurium LT2
MSQFFYIHPDNPQQRLINQAVDIVRKGGVIVYPTDSGYALGCKIEDKGAMERICRIRHLPDGHNFTLMCRDLSELSTYSYVDNVAFRLMKNNTPGNYTFILKGTKEVPRRLLQEKRKTIGLRVPSNPIALALLDTLGEPMLSTSLMLPGSDFTESDPEEIKDRLEKQVDLIIHGGYLGQQPTTVIDLTNDSPVVLREGVGDVTPFL

SEQ ID NO: 14513 - DNA, 660 bp, Nostoc sp. PCC 7120
  CDS (1)..(660): transl_table=11
atggcaaaaattatcgctgtccatcctgataatccccagagtcgcagaatagaggaaataaggtcagcgctttccagtggcgcggtgatgctttatccaactgatacggtttatgcgatcggttgtgatttaaatgtcaagtctgcggtggaaagagtgcggcaaatcaagcaattagcaaacgataaaccactgacatttctatgtccttcactgtctaatgtagctacttatgcctttgtcagtgatacagcttatcgaattatgaagcgactaataccaggaacttacacatttttgttacctgcaactaagttagtaccaagattagtccaaagtcccaagcgtaaaactactggaattcgcgtaccaaatcatactgtatgtttagccttacttgaagccttggggaatccgattatttccacttcagcacacatcccgccagatgaggcaggtaacgggaaagtcgggataatttcagaatcgattacctcaatggtagagctatttgaccgcgtggataaattagttgatgtgattgtagacactggacaggaaccaacttacgatgtgtctacaattgttgatttgacgggagatgagccaatgattacgagacaaggattaggctgggaagcggtaacagcgtgggtataa

SEQ ID NO: 14514 - protein, 219 aa, Nostoc sp. PCC 7120
MAKIIAVHPDNPQSRRIEEIRSALSSGAVMLYPTDTVYAIGCDLNVKSAVERVRQIKQLANDKPLTFLCPSLSNVATYAFVSDTAYRIMKRLIPGTYTFLLPATKLVPRLVQSPKRKTTGIRVPNHTVCLALLEALGNPIISTSAHIPPDEAGNGKVGIISESITSMVELFDRVDKLVDVIVDTGQEPTYDVSTIVDLTGDEPMITRQGLGWEAVTAWV

SEQ ID NO: 14515 - DNA, 624 bp, Ralstonia solanacearum GMI1000
  CDS (1)..(624): transl_table=11
atgtcccagttcttccagatccatccgaccacgccgcaggggcggctgatccgccaggcggtggaaatcatccgcgccggcggcctgatcgcgctgccgaccgactcctgctacgcgctggcctgccacctggatgacaaggccgccgtggagcgcttgcgccgcgtgcgcggcatcgacgaaaagcaccacctgacgctgatgtgccgggacctgtcggagctggccaccttcgcccgcgtcgacaaccggcagtatcgcgcggtcaaggcggccacgcccggcccgttcgtcttcctgctggaggcgacccgggaggtgccgcgccggctgtcgcatccgtcgcgcaagaccatcggcctgcgcgtgcccgaccacccgatcccgctggcgctgatggccgagctgggcgagccgctgctgtccgccacgctgcagctgccgggcgacgaagcgccgctcaacgaagcggatgccatccgcgccctgctggagcggcaactggagctggtgatcgacggcggcccggccccggcagagcccaccaccgtgatcgacctgaccggcggcgagccggaactggtgcgcagggggcgcggcgacccggccagggtcggcctgtag

SEQ ID NO: 14516 - protein, 207 aa, Ralstonia solanacearum GMI1000
MSQFFQIHPTTPQGRLIRQAVEIIRAGGLIALPTDSCYALACHLDDKAAVERLRRVRGIDEKHHLTLMCRDLSELATFARVDNRQYRAVKAATPGPFVFLLEATREVPRRLSHPSRKTIGLRVPDHPIPLALMAELGEPLLSATLQLPGDEAPLNEADAIRALLERQLELVIDGGPAPAEPTTVIDLTGGEPELVRRGRGDPARVGL

SEQ ID NO: 14517 - DNA, 924 bp, Arabidopsis thaliana
  CDS (1)..(924)
atggcggtggccaaacttcacggcggaggtatggcggcgatgcgtcttcttctacttccttccccgatgacgcaccggcgaccatcaacgcttccgagcactgcctctttatctccacggagatacatcgtcgcgttggcggccaagagaagccctaagcgtctcaaatactctactcctcgtttcaccaaggagggggaattggtgtacatcgaggtcgatccttgtggtgttgattcctggaaactccaacctgtcattgaccttctcaaacaaggagctgttggtgttattcccactgataccgtatatgccattgcttgtgattgtaaaaaccattccgctgttgagcgtctccgaaggattaaaaagattgaatcctccaagccacttagcatcttatgccgttccttacgagatattgacacttttacaatgggctttcctcgtggtgatggtcatggtcatgctaacgtttttcgagctgtcaagcaatgcttacctggtccttataccttcatcttgactgcaagcaaggaactacccaaacagtgtgtaggttatggcaccacaagtgtgaaatatgcatctaggaaaaacgtgggtgtccgcatatctgatgatgctctctgccaagctattctgcagcagatggatgccccattgatttgcacaagtgtgaaagggcctaaagaaaatgaatggatgatcgacccaaccgcaataggtgacatatatggaccagagggtctggattttgtggtagacggaggtatacgagtggctgaaccatccaccatcgtggatatgacaggaccatatcccaaggtcataagggaagggaagggacctatattgccgtggatggtggttgaggacgacgagtcttccctgcgccaagatcttatggcgtctggcacttaa

SEQ ID NO: 14518 - protein, 307 aa, Arabidopsis thaliana
MAVAKLHGGGMAAMRLLLLPSPMTHRRPSTLPSTASLSPRRYIVALAAKRSPKRLKYSTPRFTKEGELVYIEVDPCGVDSWKLQPVIDLLKQGAVGVIPTDTVYAIACDCKNHSAVERLRRIKKIESSKPLSILCRSLRDIDTFTMGFPRGDGHGHANVFRAVKQCLPGPYTFILTASKELPKQCVGYGTTSVKYASRKNVGVRISDDALCQAILQQMDAPLICTSVKGPKENEWMIDPTAIGDIYGPEGLDFVVDGGIRVAEPSTIVDMTGPYPKVIREGKGPILPWMVVEDDESSLRQDLMASGT

SEQ ID NO: 14519 - DNA, 603 bp, Streptomyces coelicolor A3(2)
  CDS (1)..(603): transl_table=11
gtgcaccccgacaacccccagccgcgcagcatcgcccaggtcgccgacagcgtccgctccggcgcgctgatcgcgtatccgacggactcctgctacgcactgggctgccgactgggcagccgcgacgggatcgaccgcatccggtcgatccggcagctggacaaccggcaccacttcaccctcgtctgccaggacttcgcgcagctcgggcagttcgtgcagatcgacaacgacgtgttccgggcgatcaaggcctcgacgcccggcagctacaccttcatcctgcccgcgacgagggaggtgccgcgcgcgctccagcacccgaagaagaagacggtgggcgtgcgcatccccgaccacgtcgtcacccaggccctgctcgccgagctcggtgaaccgctgctgtccagcacgctgttgctgcccgacgaggaggagccgatgacgcagggctgggagatcaaggaccggctcgaccacgtgctggacgcggtcgtcgactccggggactgcggcaccgagcccaccacggtcgtcgacttctccggcggcgaggcggagatcgtgcggcacggcgcgggcgacacgacccggttcgagtag

SEQ ID NO: 14520 - protein, 200 aa, Streptomyces coelicolor A3(2)
MHPDNPQPRSIAQVADSVRSGALIAYPTDSCYALGCRLGSRDGIDRIRSIRQLDNRHHFTLVCQDFAQLGQFVQIDNDVFRAIKASTPGSYTFILPATREVPRALQHPKKKTVGVRIPDHVVTQALLAELGEPLLSSTLLLPDEEEPMTQGWEIKDRLDHVLDAVVDSGDCGTEPTTVVDFSGGEAEIVRHGAGDTTRFE

SEQ ID NO: 14521 - DNA, 642 bp, Thermosynechococcus elongatus BP-1
  CDS (1)..(642): transl_table=11
atggcagcaatttttgagcttcatcctgtcaacccccagccccgcgcgatcgcccaaattgttgaggctctcaaagaaggggcagttatgctctaccccacagatacggtctatgccattggctgtgacatgaaccacaagggagcggtgcaacgggtacgccaactcaagcaactctctaacgataaacccgtcacctttttgtgctcttctctctccaatattgcccagtatgcctatgtcagtgattccgcctatcgcctcatgcgtcgcctaattccgggaccctacacctttttgctgcccgctaccaaactggtgccccgccttgtccaaaatcccaaacgcaaaacgacggggatccgcgtgcctgaccatgtggtgagccaagcgctgttgactgccttgggcaatccgatcatctccacctcagcacgactacccgacgatgagacctattatgtgaataccgcagatctcttcgatgcctttgacaagcgggtggatttgatgattgatacgggggaaccgccgacacagcaaatgtccagtatccttgatctcaccgtcgaaccacccctactggtgcgcaagggacgaggctgggaagcactgccggcagaaatggtgaccgttgagtga

SEQ ID NO: 14522 - protein, 213 aa, Thermosynechococcus elongatus BP-1
MAAIFELHPVNPQPRAIAQIVEALKEGAVMLYPTDTVYAIGCDMNHKGAVQRVRQLKQLSNDKPVTFLCSSLSNIAQYAYVSDSAYRLMRRLIPGPYTFLLPATKLVPRLVQNPKRKTTGIRVPDHVVSQALLTALGNPIISTSARLPDDETYYVNTADLFDAFDKRVDLMIDTGEPPTQQMSSILDLTVEPPLLVRKGRGWEALPAEMVTVE

SEQ ID NO: 14523 - DNA, 621 bp, Shewanella oneidensis MR-1
  CDS (1)..(621): transl_table=11
atgagtcagtttttttatgtacacgaagtaaatccacaggcgcgtttgattagtcaagccgtggctgtgcttaagtccggcggcgtcattgtgtatccaaccgattcgggttatgccctcggttgcatgatcggtgagaaagacgcgatgacgcgtattacccgcattcgtcaaatcgaacacgatcataatttctccttaatgtgccgtgacttatctgagcttgcgacctatgccaaggtggataatcaggcctatcgcatcttaaaaagttgcacgccagggccgtacacttttatttttaaggcgagcaaagaagttccccgccgtctgcaaaatgacaagaagaaaaccattggtatccgcgtgccagacaacgtcatcgccttagctttgctcgaagccttagacgcgccgttgatgtcgaccagtttagtgatgccagatgcagaatttgctgagtctgatcctgaacagatccgcgatttgttagagcatcaagtggatgtgattattcacggcggttatttaggtgaaaagccaaccacagtgattgatatgtcggaagatggtttcgaagtgctgcgcgaaggggcaggagatgtcactccgtttctgtaa

SEQ ID NO: 14524 - protein, 206 aa, Shewanella oneidensis MR-1
MSQFFYVHEVNPQARLISQAVAVLKSGGVIVYPTDSGYALGCMIGEKDAMTRITRIRQIEHDHNFSLMCRDLSELATYAKVDNQAYRILKSCTPGPYTFIFKASKEVPRRLQNDKKKTIGIRVPDNVIALALLEALDAPLMSTSLVMPDAEFAESDPEQIRDLLEHQVDVIIHGGYLGEKPTTVIDMSEDGFEVLREGAGDVTPFL

SEQ ID NO: 14525 - DNA, 666 bp, Pseudomonas putida KT2440
  CDS (1)..(666): transl_table=11
atgaacagcctttggcgctatgaacaggacgattacgtgagccaatttttccagattcatccggagaacccacaagcgcgcctgataaaacaggccgtcgagatcatccgcaaggggggcgtggtggtgtatccgacggattcggcgtatgcgctgggttgccagataggcgacaagtcggcaatcgagcgggtgcggcgcctgcgcgggctggacaagacgcacaacttcaccctgatgtgctgcgacatgtcgcaactggggttgtacgccaaggtcgacaccggcaccttccgcttgctgaaggcgcatgtgccggggccttacaccttcatcctcaacggcacgcgtgaagtgccgcgcctgctgttgcacgataagcggcgtaccatcgggctgcgtgtaccggaccatgccatcaccctggccttgctggccgagttgggcgagccactgatgagcgtcagcctgatcctgccgggcgacagcgagccgatgaccgacccttacgagatccgtgaacggctggagcaccatgttgacctggtgatcgatggcgggttcggcgacctcaaggcgtcgaccatcatcgacctgtccggcgacgaaccggaactgatccgcgaaggttgtggcgaccccacgccattcctggtcaacgcgtga

SEQ ID NO: 14526 - protein, 221 aa, Pseudomonas putida KT2440
MNSLWRYEQDDYVSQFFQIHPENPQARLIKQAVEIIRKGGVVVYPTDSAYALGCQIGDKSAIERVRRLRGLDKTHNFTLMCCDMSQLGLYAKVDTGTFRLLKAHVPGPYTFILNGTREVPRLLLHDKRRTIGLRVPDHAITLALLAELGEPLMSVSLILPGDSEPMTDPYEIRERLEHHVDLVIDGGFGDLKASTIIDLSGDEPELIREGCGDPTPFLVNA

SEQ ID NO: 14527 - DNA, 621 bp, Vibrio vulnificus CMCP6
  CDS (1)..(621): transl_table=11
atgagccagtttttttacgttcatccagaaaacccacaggctcgcttgattaatcaagccgtagcaatcattcgaaatggcggagtggtggtgtatccaaccgattcaggatacgcgttgggctgtcaattagaaaacaagcaagcattagacagaatttgccagatccgtcgcttagacgaaaaacacaacttcacactgttgtgccgtgacctttcagagttgtccatttacgcacgtgtggataacacggcgtttcgtttgttaaagaacaacactccaggtccttacacctttatttttaaagggaccaaagaagtgccgcgtcgtttgatgaacgctaagcgtaagaccataggtattcgtgtacccgataaccgtattgccctagatctgcttgatgcgttgggtgagccattgatgtcgacatcactgattttgccaggcaaagaggtaacggaagccgatccagaagagatccgcgataaacttgaacacgcggttgatgtgattcttaacgggggttacttgggcgagcaaccaacgacggtgattgactttagtgaaggtgatgcggttgttgcacgtattggctctggtgacccagcaccatttgagtaa

SEQ ID NO: 14528 - protein, 206 aa, Vibrio vulnificus CMCP6
MSQFFYVHPENPQARLINQAVAIIRNGGVVVYPTDSGYALGCQLENKQALDRICQIRRLDEKHNFTLLCRDLSELSIYARVDNTAFRLLKNNTPGPYTFIFKGTKEVPRRLMNAKRKTIGIRVPDNRIALDLLDALGEPLMSTSLILPGKEVTEADPEEIRDKLEHAVDVILNGGYLGEQPTTVIDFSEGDAVVARIGSGDPAPFE

SEQ ID NO: 14529 - DNA, 630 bp, Pseudomonas syringae pv. tomato str. DC3000
  CDS (1)..(630): transl_table=11
gtgagtcaatttttccaggtccatccggaaaacccgcagccgcgcctgatcaaacaggccgcggaaatcataaaagccggcgggctggtggtctacccgacagattcctcctacgcgctgggttgccagatcggcgacaagagcgccatcgagcgtatccgccgcctgcgccagctggacgacaaacacaacttcaccctgatgtgctgcgacctgtcgcaactggggctgtttgccaaggtcgacaccggcgcgttccgcgcgctcaaggcgcacacgccagggccttacacctttattctcaacgccacccgagaagtgccgcgcctgattttgcaccccaagcgccgcaccatcggcctgcgtgtgccgagccaccccatcgcccaggcgttgctggagcaactgggcgagccgctgatgagcgtcagcctgatcatgccgggtgacaccgtgccgctcagcgatccctacgaaatgcgccagattctcgagcatcacgtggacctgatcatcgatggcgggatcggcggtatttcggcgtccaccgtgatcaacctgtccgagggcgagccgcagatcgttcgtgtcggttgtggtgacccaaccccgttcggtgaccgcgcttaa

SEQ ID NO: 14530 - protein, 209 aa, Pseudomonas syringae pv. tomato str. DC3000
MSQFFQVHPENPQPRLIKQAAEIIKAGGLVVYPTDSSYALGCQIGDKSAIERIRRLRQLDDKHNFTLMCCDLSQLGLFAKVDTGAFRALKAHTPGPYTFILNATREVPRLILHPKRRTIGLRVPSHPIAQALLEQLGEPLMSVSLIMPGDTVPLSDPYEMRQILEHHVDLIIDGGIGGISASTVINLSEGEPQIVRVGCGDPTPFGDRA

SEQ ID NO: 14531 - DNA, 621 bp, Vibrio parahaemolyticus RIMD 2210633
  CDS (1)..(621): transl_table=11
atgagccagtttttttacgttcatccagaaaacccacaggctcgcttgatcaatcaagcagtagcaatcattcgtaatggcggtgtcgtggtttacccgacagattcagggtatgcacttggttgccaattggagaacaaacaagcgctagagcgcatttgtcagattcgtcgcttagatgataagcacaacttcacgttgttgtgtcgcgatttgtcagaaatttctctgtatgcgcgcgtggacaacggagcattccgactactgaaaaacaacactcctggtccttacacgttcatcttcaaaggtacgaaggaagttcctcgtcgcttgatgaatgcgaaacgtaagactatcggtattcgtgtgccaaataaccaaatcgcattggatcttctcgaagcactgggtgagccattgatgtcaacgtcattgattctacctggtagcgatgtgacagagtctgatccggaagatatccgcgacaaacttgaacatgcagttgatgtgatcctgaatggtggttacttaggtgagcaacctactacagtgattgacttcagcgaaggtgagccagaagtggtgcgaattggttctggcgatccatcaccattcgaataa

SEQ ID NO: 14532 - protein, 206 aa, Vibrio parahaemolyticus RIMD 2210633
MSQFFYVHPENPQARLINQAVAIIRNGGVVVYPTDSGYALGCQLENKQALERICQIRRLDDKHNFTLLCRDLSEISLYARVDNGAFRLLKNNTPGPYTFIFKGTKEVPRRLMNAKRKTIGIRVPNNQIALDLLEALGEPLMSTSLILPGSDVTESDPEDIRDKLEHAVDVILNGGYLGEQPTTVIDFSEGEPEVVRIGSGDPSPFE

SEQ ID NO: 14533 - DNA, 615 bp, Bacteroides thetaiotaomicron VPI-5482
  CDS (1)..(615): transl_table=11
atgcttctgaaactgtacgataaaaacaataacccgcaggacttgcaacgggtaaccgacatcctgaacgacggcggactgatcatctatcctacggatacgatgtacgccatcggatgccacgggctgaaagaacgtgctattgaacggatttgccggatcaaagatattgatccgcgcaaaaacaacctgtctatcatctgctacgatctaagcagtatcagcgagtatgccaaagtgggtaataatgagttcaagctcatgaagcataatctccccggtccgttcacgtttatcctgaatggcaccaaccggctgcccaaaatcttccgcaaccgaaaagaggtgggtatccgtatgccggacaacaacatcattcgtgaaatcgcccgcttactggatgctcctattatgaccaccacactgccatatgatgagcatgaagatctggaatatatgaccgatcccgaactgattgacgaaaagttcggcgatatcgtggatctggtgatcgacggaggaataggaggcatagaaccttctacagtagtgaagtgcacagaagatgaaccggaaattgtccgtcagggaaaaggctggctggaagggatttaa

SEQ ID NO: 14534 - protein, 204 aa, Bacteroides thetaiotaomicron VPI-5482
MLLKLYDKNNNPQDLQRVTDILNDGGLIIYPTDTMYAIGCHGLKERAIERICRIKDIDPRKNNLSIICYDLSSISEYAKVGNNEFKLMKHNLPGPFTFILNGTNRLPKIFRNRKEVGIRMPDNNIIREIARLLDAPIMTTTLPYDEHEDLEYMTDPELIDEKFGDIVDLVIDGGIGGIEPSTVVKCTEDEPEIVRQGKGWLEGI

SEQ ID NO: 14535 - DNA, 633 bp, Nitrosomonas europaea ATCC 19718
  CDS (1)..(633): transl_table=11
atggcccaatttttttccatacacccgcaaacgcctcatacaagactgatccgccaggcagtcgatatcgtacgcaaaggcggagtcatcgcttatccaaccgattcctgctacgcactgggttgccagatcggtaacaaagaggcgatggatcgtatccgtaccatccgcaaagtggatcagaatcacaatttcacactggtatgccgggatctggcagagattgcaacgtatgcgaaagtggataatgcacaataccgtctgctcaaggcagccactcccggcagctataccttcattctggcagcaacccgcgaagtcccacgccgtctgcagcatcccaaacgccacacgatcgggttgcgtattcctgatcaccctgtcgtacaggctctactggccgaactggacgaacctttgctgagttcgacgctcattcttcctggagatgaactgccattgaatgatgctggagaaatccgccagcgtctggagcaccagatcgaactggtcatggatgccggttcctgcggcaccgacatgaccacggtcatcgacctgaccgaaaccaccccgaaagttgcccgttctggaaaaggcgatctgtcaccctttggaatcattaatggataa

SEQ ID NO: 14536 - protein, 210 aa, Nitrosomonas europaea ATCC 19718
MAQFFSIHPQTPHTRLIRQAVDIVRKGGVIAYPTDSCYALGCQIGNKEAMDRIRTIRKVDQNHNFTLVCRDLAEIATYAKVDNAQYRLLKAATPGSYTFILAATREVPRRLQHPKRHTIGLRIPDHPVVQALLAELDEPLLSSTLILPGDELPLNDAGEIRQRLEHQIELVMDAGSCGTDMTTVIDLTETTPKVARSGKGDLSPFGIING

SEQ ID NO: 14537 - DNA, 618 bp, Haemophilus ducreyi 35000HP
  CDS (1)..(618): transl_table=11
atgagtcaatttttctatgttcatcctgataatccacaggttcgtttaattaatcaagcggttgaaattattaaaaatggtggcgtaattatttatccaacagattcaggctatgcattaggctgcgcaataggtgaaaaacatgcaatggatagaattgttgctatccgtaagttgccagaaaaccataattttacacttgtttgtagtgatctagctgaactttcaacttatgcattggtgactaatcagtcgtatcgtctgattaaaaacaatacacctaatccttacacttttattttgcctgcaactaaagatgtgccacgtagattaatgacaaagcgtaaaacaattggtattagagttccaaataatacgattgcattagcattaatttctgcgttaggtgaaccgattctttcttgttcattaatgttgcctgatactgaaataacggaatctgatccggatgaaatccgccaacatttagagcatcgagtggatctgattattcatggcggttatttagggcaacagccgaccacggtggttgatttaacaggcgatactccaatgattttgcgtgaaggttcaggtgatctcagctcatttaattaa

SEQ ID NO: 14538 - protein, 205 aa, Haemophilus ducreyi 35000HP
MSQFFYVHPDNPQVRLINQAVEIIKNGGVIIYPTDSGYALGCAIGEKHAMDRIVAIRKLPENHNFTLVCSDLAELSTYALVTNQSYRLIKNNTPNPYTFILPATKDVPRRLMTKRKTIGIRVPNNTIALALISALGEPILSCSLMLPDTEITESDPDEIRQHLEHRVDLIIHGGYLGQQPTTVVDLTGDTPMILREGSGDLSSFN

SEQ ID NO: 14539 - DNA, 627 bp, Bordetella parapertussis 12822
  CDS (1)..(627): transl_table=11
atggccctgcttctgacactacatcccgcgaatccgcagccacgcttgatcaaacaggctgcgcaatggctgtccgacggcgggctggtggccgtgccgaccgactccagctacgccgtggtggcgccgctggacgacaaggcggccgccgatgcgctgcggcgcctgcgcggcctggacgagcgccaccatctgaccctgctgtgccgcgacctggccgagatcggccaggtcgcgcgggtcgacaacaagcagtaccgcctgctcaaggccgccacgccggggccgtggacgttcatcctggaagccacccgcgaagtgccgcgccgcgtctcgcatccgtcgcgcaagaccatcggcatccgggtgccggcgcacgcggtggcgctggcgctgctggagcaggtgggcgcgccgctgctgtcgaccaccctgattcccagggacgaggaagacgcgctcaatgatcccgaggccatccaggagcgctaccagcacgaactggcggcggtgatcgatgccggggcctgcccgcagacgcccaccacggtggtcgacctgaccggcgccgagccggcggtgctgcggcgcggcggcggcgatccggcggcgctcgggctggactag

SEQ ID NO: 14540 - protein, 208 aa, Bordetella parapertussis 12822
MALLLTLHPANPQPRLIKQAAQWLSDGGLVAVPTDSSYAVVAPLDDKAAADALRRLRGLDERHHLTLLCRDLAEIGQVARVDNKQYRLLKAATPGPWTFILEATREVPRRVSHPSRKTIGIRVPAHAVALALLEQVGAPLLSTTLIPRDEEDALNDPEAIQERYQHELAAVIDAGACPQTPTTVVDLTGAEPAVLRRGGGDPAALGLD

SEQ ID NO: 14541 - DNA, 627 bp, Bordetella bronchiseptica RB50
  CDS (1)..(627): transl_table=11
atggccctgcttctgacactacatcccgcgaatccgcagccacgcttgatcaaacaggctgcgcaatggctgtccgacggcgggctggtggccgtgccgaccgactccagctacgccgtggtggcgccgctggacgacaaggcggccgccgatgcgctgcggcgcctgcgcggcctggacgagcgccaccatctgaccctgctgtgccgcgacctggccgagatcggccagttcgcgcgggtcgacaacaagcagtaccgcctgctcaaggccgccacgccggggccgtggacgttcatcctggaagccacccgcgaagtgccgcgccgcgtctcgcatccgtcgcgcaagaccatcggcatccgggtgccggcgcacgcggtggcgctggcgctgctggagcaggtgggcgcgccgctgctgtcgaccaccctgattcccagggacgaggaagacgcgctcaatgaccccgaggccatccaggagcgctaccagcacgaactggcggcggtgatcgatgccggggcctgcccgcagacgcccaccacggtggtcgacctgactggcgccgagccggcggtgctgcggcgcggcggcggcgatccggcggcgctcgggctggactag

SEQ ID NO: 14542 - protein, 208 aa, Bordetella bronchiseptica RB50
MALLLTLHPANPQPRLIKQAAQWLSDGGLVAVPTDSSYAVVAPLDDKAAADALRRLRGLDERHHLTLLCRDLAEIGQFARVDNKQYRLLKAATPGPWTFILEATREVPRRVSHPSRKTIGIRVPAHAVALALLEQVGAPLLSTTLIPRDEEDALNDPEAIQERYQHELAAVIDAGACPQTPTTVVDLTGAEPAVLRRGGGDPAALGLD

SEQ ID NO: 14543 - DNA, 624 bp, Chromobacterium violaceum ATCC 12472
  CDS (1)..(624): transl_table=11
atggcgcaattcttcgtgatccatcccgagaacccccaggccaggctgatccgcgaggcggtgaagatcctgcgcgagggcggggtgatcgcctatcccaccgactcctgttacgcgctgggctgcgcgctcggcgacaaggaggcgatggagcggattctggagatccgcggcgtggacctgaagcagcggctgatgacgctggtgtgccacgatctgtccgaactggccaactacgccaaggtggacaaccgccagtaccggctgctgaagagcaccacgccgggcagctacaccttcatcctgcaggcgacgcgcgaggtgccgcgccgcacgctccaccccaagcgggccaccatcggcctgcgcgtgccggaccacaaggtggcgctggccttgttggaggagctgggcgaacccatcttgtcctgtaccctgatgctgccgggcgacgacgtcccgatgtccgacccctacgaaatccgtgagcggctggagcatctggtggacgcggtgctggacggcggctggtgcggcaccgagccgaccaccgtggtcgacatgaccgacggtgtcgagctggtgcgcgaaggcaagggcgcgctggcgccgttcggtttttga

SEQ ID NO: 14544 - protein, 207 aa, Chromobacterium violaceum ATCC 12472
MAQFFVIHPENPQARLIREAVKILREGGVIAYPTDSCYALGCALGDKEAMERILEIRGVDLKQRLMTLVCHDLSELANYAKVDNRQYRLLKSTTPGSYTFILQATREVPRRTLHPKRATIGLRVPDHKVALALLEELGEPILSCTLMLPGDDVPMSDPYEIRERLEHLVDAVLDGGWCGTEPTTVVDMTDGVELVREGKGALAPFGF

SEQ ID NO: 14545 - DNA, 603 bp, Porphyromonas gingivalis W83
  CDS (1)..(603): transl_table=11
atgatcatcaagatttaccccgacaatcccaacagacgagaattggaacgtgccgtatcggctcttcgcgacggcaaagtgatcatctatcccaccgaagttgggtatgcctacggatgcgatgcccttcagaatcggagcgtggagcggatatgcgagctgaaaggtgtggatcctcggcgcaaaagcctctcgatcatgtgttcggacatgagcatggcagccgaatactgccgtatagacaacgaggcattccgctatatgaaggacaaccacatgcagaaatataccttcgtcctaccggccggaagttcgctgcctaaggttttcaagaatcgaaagcaggtaggtatccgcctggctcttcatccactgacccgtcttcttgccgaatcgctcggcagtcctttgctgaccggctcgctccccctcgatcctgaaacgcccgaatacgcttcggatcccgaactgatcgaagagcgctatggccttacggtagaaatggtactcgacggaggaatcatcccgttcgaacagaccacggtggtcgactgcaccgtctcgccctacaccattctgcgcgaaggcggaagcaagccttag

SEQ ID NO: 14546 - protein, 200 aa, Porphyromonas gingivalis W83
MIIKIYPDNPNRRELERAVSALRDGKVIIYPTEVGYAYGCDALQNRSVERICELKGVDPRRKSLSIMCSDMSMAAEYCRIDNEAFRYMKDNHMQKYTFVLPAGSSLPKVFKNRKQVGIRLALHPLTRLLAESLGSPLLTGSLPLDPETPEYASDPELIEERYGLTVEMVLDGGIIPFEQTTVVDCTVSPYTILREGGSKP

SEQ ID NO: 14547 - DNA, 672 bp, Gloeobacter violaceus PCC 7421
  CDS (1)..(672): transl_table=11
atggccaacacttactatctgcaccccaaagacccgcagcccgaacgcctcgggcggattgtgcaggcgctgcgcgctggggccgtcttgctctatcccaccgacaccacctacgccatcggctgcgatttgctccacaagggcgccatcgagcgggtgcagcgcatcaagcgcctcagcaacgacaagccgctcacctttttgtgcccgtcgctttcgaacgtggccacctacgcccgggttggcgacgacgcctaccgcctgatgcgccacttgctccccggtccctatacttttttgctgcccgccacccgcgccctgccgaagctggtgctcgatcctaaacgccgcaccaccggcatccgagtccccgaccacccgctctgccaggcgctgcttgcgggattgggcaacccgctcatctccacttccgcccgctcggcggatgggagcgaaatccgctacgaatacgaactattcgaagcgctcgccccggtggtcgatgggatcgtcgaattggaccccccggcccaggacggcctgctcctcacccaggtctcgacggtgatcgacctgagcggggagcaacctgtcgtcgtgcggcggggactcggctgggagcgggcggccacctttttgcagcgggccgggtacgcccctgagcccgcctga

SEQ ID NO: 14548 - protein, 223 aa, Gloeobacter violaceus PCC 7421
MANTYYLHPKDPQPERLGRIVQALRAGAVLLYPTDTTYAIGCDLLHKGAIERVQRIKRLSNDKPLTFLCPSLSNVATYARVGDDAYRLMRHLLPGPYTFLLPATRALPKLVLDPKRRTTGIRVPDHPLCQALLAGLGNPLISTSARSADGSEIRYEYELFEALAPVVDGIVELDPPAQDGLLLTQVSTVIDLSGEQPVVVRRGLGWERAATFLQRAGYAPEPA

SEQ ID NO: 14549 - DNA, 621 bp, Photorhabdus luminescens subsp. laumondii TTO1
  CDS (1)..(621): transl_table=11
atgagccagtttttttatattcatccagataatccgcagccccgcttaatagggcaaagtgtggatatgttgaaaaaaggtggggtggttatttaccccactgattccggttatgcgattggttgccatctggaagataaagattcgatgactcggatatgccgtatccgccagttagatagtcatcataatttcaccttaatgtgtcgggatttgtcagaaatatcgacctatgcttatgttgataattcagcttttcggctgattaaaaataatacgccgggcaattacacgtttattttgcgtgcgacgaaagaagtccctcgccgtttgatgaatgataagcggaaaactatcgggttacgtgttccatccaatccaattgccttggcgcttcttgaacaagtgggtgagccattgatgtccacgagcctgattttgccaggcaatgattttgctgaatctgatcctgaagaaattaaagataatttgggaaaacaggttgatctgattattcatgggggttatttagggcaacagcctaccaccgtaattgatttaactgaggatacgccggttgtaatacgggaaggggctggcaatatcacgccattcttataa

SEQ ID NO: 14550 - protein, 206 aa, Photorhabdus luminescens subsp. laumondii TTO1
MSQFFYIHPDNPQPRLIGQSVDMLKKGGVVIYPTDSGYAIGCHLEDKDSMTRICRIRQLDSHHNFTLMCRDLSEISTYAYVDNSAFRLIKNNTPGNYTFILRATKEVPRRLMNDKRKTIGLRVPSNPIALALLEQVGEPLMSTSLILPGNDFAESDPEEIKDNLGKQVDLIIHGGYLGQQPTTVIDLTEDTPVVIREGAGNITPFL

SEQ ID NO: 14551 - DNA, 612 bp, Geobacter sulfurreducens PCA
  CDS (1)..(612): transl_table=11
atgcttctctccattaatcccgacaatccgcaggcacgacttatctcccacgtggctgaggttcttggtcgtggcggggtcatcgcgtacccgaccgacacgacctatgggatcggttgcagcatcttcagtaagaaggggatcgaacgaatttatcttctcaagcaaagggagaagaagaagcccttttcctttatctgttcggaactctcagaggttgctcgttacgccaaggtcagtaattacgcctacaaaatcctgaagcggtatttgccgggaccctacacttttgtaatcgatgcaacaagcgtagtccctgatctgctggtgaccaagcagaagacggtcggtattcgaatccctgacaaccggatatgtattgcgctcgtcaaggagttggggcacccgatcgtcaccaccagcgcaaatctctcgggagaagaacccatcggcgatccgctggaagtcgagcgaacactgggaaagcagctcgatctcgtcgtggacggcgggaatctcaccgccgacgtcagttcggttgtgagtctgatcggtgattatccccaggtgttgcgccgcgggatcggcgatgtgagctggtgcggcgaatag

SEQ ID NO: 14552 - protein, 203 aa, Geobacter sulfurreducens PCA
MLLSINPDNPQARLISHVAEVLGRGGVIAYPTDTTYGIGCSIFSKKGIERIYLLKQREKKKPFSFICSELSEVARYAKVSNYAYKILKRYLPGPYTFVIDATSVVPDLLVTKQKTVGIRIPDNRICIALVKELGHPIVTTSANLSGEEPIGDPLEVERTLGKQLDLVVDGGNLTADVSSVVSLIGDYPQVLRRGIGDVSWCGE

SEQ ID NO: 14553 - DNA, 837 bp, Chlamydomonas reinhardtii
  CDS (1)..(837)
atgctgcagcatagacatgtagcgttctcgggctcgtcgagcccggcaaggtctgggcgacgagcggctcctgcgggcatgccgaatggccgtggcaaactagttgtcgtggcctatcagaagctgcagaaacggctcaagtactcgggagctgcaggccagagagggaaagaaccgctcgtcgtgcatgtggagccggacgcaagcaacgcctggcgtctggacgaggtggtgcagctcattaaggccggcggcgtgggcgtgatccccaccgacacgctgcccgctatcgtgtgcgacctgcacaacagggacgccgtactgcggctgtacagcgtcaaggagatggacgcgcgcaagccgctgtccatcctgtgtccctcgctctccaccatcaccacctacaccaccggcttccccaccaccgcctccgccaactggttcaacgtggcacggcgcctgctgcccgggccgtacacgtttgtgctgcccgccaccaagaacctgcccccccagtgcattgacttcatgagcggcaagaacattcaccgcaagagcgtgggcgtgcgcatgccggcagacgccgtgtgccaggcgctgctggacggcgtgggcggcgcgctgctgtgcaccagcgtgcacgtgcccgaggtgctgtcgcccgacaccgaggtgcccgactgcggctccatcctggaggcgtacggcagcaaggggatagacttcgtggtggatgtgggccggcgtgtggtggtggagagcagtgtggtggacttcaccagcggcgaccccgaggtgctgcgccagggacagggcgacgtcagcgcattcgagtga

SEQ ID NO: 14554 - protein, 278 aa, Chlamydomonas reinhardtii
MLQHRHVAFSGSSSPARSGRRAAPAGMPNGRGKLVVVAYQKLQKRLKYSGAAGQRGKEPLVVHVEPDASNAWRLDEVVQLIKAGGVGVIPTDTLPAIVCDLHNRDAVLRLYSVKEMDARKPLSILCPSLSTITTYTTGFPTTASANWFNVARRLLPGPYTFVLPATKNLPPQCIDFMSGKNIHRKSVGVRMPADAVCQALLDGVGGALLCTSVHVPEVLSPDTEVPDCGSILEAYGSKGIDFVVDVGRRVVVESSVVDFTSGDPEVLRQGQGDVSAFE

SEQ ID NO: 14555 - DNA, 876 bp, Physcomitrella patens subsp. patens
  CDS (1)..(876)
atggcttacgtgcgctgtccctcccttcatcccgcacctccgcgtctacttgtcactgtacaagctgtcgccaagcgtagtcccaagcgcctcaagtactcttctcctgcctcacgcaagaattcccaggtccaattggtacaactcgatccatctggctctgatgtctggcgcttggatcctcttgtcgaactcataaagtccggggctgtgggaatcatccccactgataccgtatacgcgattgtttgtgatctcaagaatcggcaagccattgaccgtctatacagaattaagaacatggaccccatgaagccattgagtattctatgtaggtcattccaagacattgacaaatacacattggggtttccacgaggcaatagccatggccaaacaaacgtcttccgagctgctcgacagtccctccccggaccttatacatttattcttcctgcgagtaaggagatgcccaaacagtgcacaacgtttggtggaagttctgcagtaagctgtgcaccacgtaaaagtgttggtgtccgaatgccggatgatgttatttgtgcagaactactcaaacgactggatgagcccttgctatgtaccagtgtgagacagcggtcagaggatgagtggatgctagacccagttattatcgctgatacctatggtgcctctgaaggcagggagggcgtcgactttgtcatagatggaggcgaacgtcttgcttatccatcaacagtaatagacatgacgggtgaaaaacctattatcttgagacgtggaaaaggtcctgtggaagagtggatgcttatggaatctcacgactcaaccgaagctgtcgggatggatggcttgctgaacccttatgcttaa

SEQ ID NO: 14556 - protein, 291 aa, Physcomitrella patens subsp. patens
MAYVRCPSLHPAPPRLLVTVQAVAKRSPKRLKYSSPASRKNSQVQLVQLDPSGSDVWRLDPLVELIKSGAVGIIPTDTVYAIVCDLKNRQAIDRLYRIKNMDPMKPLSILCRSFQDIDKYTLGFPRGNSHGQTNVFRAARQSLPGPYTFILPASKEMPKQCTTFGGSSAVSCAPRKSVGVRMPDDVICAELLKRLDEPLLCTSVRQRSEDEWMLDPVIIADTYGASEGREGVDFVIDGGERLAYPSTVIDMTGEKPIILRRGKGPVEEWMLMESHDSTEAVGMDGLLNPYA

SEQ ID NO: 14557 - DNA, 624 bp, Herminiimonas arsenicoxydans
  CDS (1)..(624): transl_table=11
atgagccaattttttcagatacacccggaaaatccgcaggcgcgcctgatcagtcaggccgtggaggtcatcaaaggcggcggcatagtcgcattgccgacggactcctgttatgcgctggtctgtcaacttgacgacaaggatgcagtggcgcgtttgcgacgtatacgcaatgtcgacgacaagcatcatctgactttgttgtgtcgcgacttgagcgagattgcccagtatgcgaagatcgataatcagcaataccgcctgctgaaagccgcaacgccgggcgcctacacctttattctggaagcgacgaaggaagtgccgcgtcgtctgagccatccatcgcgcaagacgataggtttgcgcgtaccggaaaatcgtattgtgcatgcagtgctggaagaactggcgcagcctttgctcggcactaccctgattctgccgggtgaagatgagccgctgaccgatcccgatgacgtgcgtgatcgcctgagcaaagttgttgatctggtcatcgatggcggcgcctgcagtttcataccgacgacagtcatcgatctgaccggccccgagcctgtgctgcagcggcagggacgcggcgatgctgcaccatttggtctgtaa

SEQ ID NO: 14558 - protein, 207 aa, Herminiimonas arsenicoxydans
MSQFFQIHPENPQARLISQAVEVIKGGGIVALPTDSCYALVCQLDDKDAVARLRRIRNVDDKHHLTLLCRDLSEIAQYAKIDNQQYRLLKAATPGAYTFILEATKEVPRRLSHPSRKTIGLRVPENRIVHAVLEELAQPLLGTTLILPGEDEPLTDPDDVRDRLSKVVDLVIDGGACSFIPTTVIDLTGPEPVLQRQGRGDAAPFGL

SEQ ID NO: 14559 - DNA, 633 bp, Burkholderia vietnamiensis G4
  CDS (1)..(633): transl_table=11
atgtcccagttcttcaggattcatcccgataatccgcagccgcgcctcgtcaagcaggccgccgacatcgtcagcaagggcggcgtgatcgcgatgccgaccgattcgagctacgcgctcgcgtgccacctcgacgacaaggacgcggtcgagcgcgtgcgccggattcgcggcctcgacgagaagcagcatctgtcgctgctcgtgcgcgacctgtcggagctggccaatttcgcgatggtcgacaaccgccagtaccggctgatcaagtcggtgacgccgggcccttacgtgttcatcctgcaggcgacgaaggaggtgccgcgccggctgtcgcacccgtcgcgcaagacgatcgggctgcgcgtgccggatcacgcgatcacgctcgcgctgctcgaatcgctcggccagccgctgctcggcacgacgctgatcctgccgcccgacgacgagccgctcaacgatccggaggacatccgcgcgcggctcgagaagcaggtcgatctggtgatcgacggcggcgcgtgcccgcgcgaaccgtcgaccgtgatcgacctgacgggcgacgcgccgcagctcgtgcgcgccgggcgcggcgcgctcgaaccgttcgggttgtcggccgcgtaa

SEQ ID NO: 14560 - protein, 210 aa, Burkholderia vietnamiensis G4
MSQFFRIHPDNPQPRLVKQAADIVSKGGVIAMPTDSSYALACHLDDKDAVERVRRIRGLDEKQHLSLLVRDLSELANFAMVDNRQYRLIKSVTPGPYVFILQATKEVPRRLSHPSRKTIGLRVPDHAITLALLESLGQPLLGTTLILPPDDEPLNDPEDIRARLEKQVDLVIDGGACPREPSTVIDLTGDAPQLVRAGRGALEPFGLSAA

SEQ ID NO: 14561 - DNA, 627 bp, Dichelobacter nodosus VCS1703A
  CDS (1)..(627): transl_table=11
atgaccactataatcgacgctcgattgggttttattaaacccaaagaacaaaatgaaattttaaatatactcgacaaaggcggcgttatcgttgcgcccagcgatacgggttacgcccttttatgccgtttagacgccaaaaatgccagcgtacgcattcggcggctgcgtcaattagatgacgatcattttttcacgttattgtgcagcgatttaacgcatttaagccattatgcacgcgtggataatgtgcaatttcggctgttaaaaacattatttccaggcgcgtttacctgcattttgccggcaagccgcgaagtgccgcgtttggtgcaacacgaaaaacgcaaaaccatcggcattcgtctacctaatcacccgattttgcaaccgctgattacggcgcacggcgcggcgttaatgggcgtttctttgtttgatgatagcgaaagaaatcccgatgtttatcagcttgataaagcgcaattgaacagtttggatttgattattgacgttggcgaattggcagtgacgccgtcaacggttttagatttaaccgttatgccgccaaccattattcgccacggcgccggcgatgcctcttttatagaaaggaatacattatga

SEQ ID NO: 14562 - protein, 208 aa, Dichelobacter nodosus VCS1703A
MTTIIDARLGFIKPKEQNEILNILDKGGVIVAPSDTGYALLCRLDAKNASVRIRRLRQLDDDHFFTLLCSDLTHLSHYARVDNVQFRLLKTLFPGAFTCILPASREVPRLVQHEKRKTIGIRLPNHPILQPLITAHGAALMGVSLFDDSERNPDVYQLDKAQLNSLDLIIDVGELAVTPSTVLDLTVMPPTIIRHGAGDASFIERNTL

SEQ ID NO: 14563 - DNA, 621 bp, Klebsiella pneumoniae subsp. pneumoniae MGH 78578
  CDS (1)..(621): transl_table=11
atgagccagtttttttatatccatccggataacccgcaggcgcggttgattaaccaggcggtggagattgtgcgtaagggcggggtgatcgtttatcctaccgactccggctacgcgctgggctgcaaaattgaagacaagggggcgatggagcggatctgccgcattcgtcagctgccggacggccacaactttaccctgatgtgccgcgatctgtccgagctgtcaacctacgcttttgtggataatgtggcgtttcgcctgatgaaaaacaacacgccgggcaactatacctttatccttaaggggaccaaagaggtgccgcgtcggctgctgcaggagaagcgtaaaaccatcggcatgcgcgtcccgtctaaccccatcgctcaggcgttgctcgagaccttaggcgagccgatgctctccacgtcgctgatgctgcccggcagcgactttaccgaatccgacccggaagagatcaaagatcgtctggagaaagtggtggacctcatcattcacggcggtttccttgggcagcagccgaccacggttatcgatctcactgaagacaccccggtggtgctgcgcgaaggcgtcggcgacgtgaggccgtttctctaa

SEQ ID NO: 14564 - protein, 206 aa, Klebsiella pneumoniae subsp. pneumoniae MGH 78578
MSQFFYIHPDNPQARLINQAVEIVRKGGVIVYPTDSGYALGCKIEDKGAMERICRIRQLPDGHNFTLMCRDLSELSTYAFVDNVAFRLMKNNTPGNYTFILKGTKEVPRRLLQEKRKTIGMRVPSNPIAQALLETLGEPMLSTSLMLPGSDFTESDPEEIKDRLEKVVDLIIHGGFLGQQPTTVIDLTEDTPVVLREGVGDVRPFL

SEQ ID NO: 14565 - DNA, 621 bp, Kineococcus radiotolerans SRS30216
  CDS (1)..(621): transl_table=11
atggcgcgcttcgtcgaggtccacccggagaacccgcaggcccggtcgatcgcccagctcgcggcggtgctgcgcgaggacgggctcatcgcctacccgacggactcctgctacgccctgggctgccgcctggacagccacaccggcgcggaccggatccgccgcatccgccagctcggcgagaagcaccacttcacgctggtgtgcgccgacttcgcccagctgagccagttcgtgcacctggacaacgtgcagttccgggccatcaaggccgcgaccccgaacccgtacacgttcatcctgccggcgaccaaggaggtcccgcgccggttcgcgcacgcgaagaagaagacggtgggggtccgcatccccgaccaccggttcgtgcgggcgctgctcaccgagctgggtgagccgctgctgtcgagcacgctgctgctgcccggtcacgaggaccccccgaccgacggctggtcgatcaaggaggagctggaccacgtcgtggacgcggtcgtggacgccggggagtgcggcacctcccccacgaccgtcgtggactggtccgggggtttccccgacgtggtgcgggtgggggccggggacccctcgcgcttcgagtag

SEQ ID NO: 14566 - protein, 206 aa, Kineococcus radiotolerans SRS30216
MARFVEVHPENPQARSIAQLAAVLREDGLIAYPTDSCYALGCRLDSHTGADRIRRIRQLGEKHHFTLVCADFAQLSQFVHLDNVQFRAIKAATPNPYTFILPATKEVPRRFAHAKKKTVGVRIPDHRFVRALLTELGEPLLSSTLLLPGHEDPPTDGWSIKEELDHVVDAVVDAGECGTSPTTVVDWSGGFPDVVRVGAGDPSRFE

SEQ ID NO: 14567 - DNA, 609 bp, Desulfococcus oleovorans Hxd3
  CDS (1)..(609): transl_table=11
atgctgttgaaaatcaatccccagaacccacaggagcggctgattgccaaggtggtggacagccttcgccagggaggtattgtcgcttttcccaccgacactttttacgccatcggctgcgacatcatgcagaaaaaaagcgtggaaaagatttaccagatcaagcagcgccacaaaagcaagcctttcagctttatctgctgcgatctcaaggacatcagtgaatacgccaaggtcacggattatgcctaccgcaccatgaagcggcttttgcccgggccgtatacctttattctggaggggtcccgtcccctgcccaagaccatggtgtccaagcgcaaaaccgccggtatccgcgtgccggacaacgccatctgcatggccattgtccgtgccctgggcaacccggtcatctccactacggccaagctgccggacaagggggtgtttaccgacccggagctgattcacgaccacttcggcaagctgctcgatatcgtggtcgacggcggaccggtgccgtgccagccttccagcattctctcctttgttgatgaagagcctgaaatcattagaagaggtctgggaccgctggatattttcgaataa

SEQ ID NO: 14568 - protein, 202 aa, Desulfococcus oleovorans Hxd3
MLLKINPQNPQERLIAKVVDSLRQGGIVAFPTDTFYAIGCDIMQKKSVEKIYQIKQRHKSKPFSFICCDLKDISEYAKVTDYAYRTMKRLLPGPYTFILEGSRPLPKTMVSKRKTAGIRVPDNAICMAIVRALGNPVISTTAKLPDKGVFTDPELIHDHFGKLLDIVVDGGPVPCQPSSILSFVDEEPEIIRRGLGPLDIFE

SEQ ID NO: 14569 - DNA, 621 bp, Salmonella enterica subsp. arizonae serovar 62:z4,z23:--
  CDS (1)..(621): transl_table=11
atgagccagtttttttatatccatcctgacaacccacagcaacggctgattaatcaggccgtcgacattgtgcgtaaaggcggggtcattgtctatccaaccgattccggttatgcccttggttgtaaaattgaagacaaaggcgcgatggaacgtatatgtcgtattcgtcagttgcccgatggacacaactttacgttgatgtgtcgcgatctgtccgaactgtcgacctattcattcgtggataatgtggcgttccgcctgattaaaaacaatacgccgggtaattacaccttcattctgaaggggacaaaagagttgccgcgccgtttgttacaggaaaaacgtaaaaccatcggcctgcgcgtgccgtcaaacccgattgcgctggcgctgctggatacgctgagcgaaccgatgctctctacgtcgttgatgctgcctggtagcgactttaccgagtcggacccggaggagattaaagagcggctggagaagcaagtggatttgatcatccatggcggctaccttggacagcagcctaccacggtaatcgatttaaccgatgattctccggtggtgctgcgtgtaggcgtcggcgacgttacacctttcttataa

SEQ ID NO: 14570 - protein, 206 aa, Salmonella enterica subsp. arizonae serovar 62:z4,z23:--
MSQFFYIHPDNPQQRLINQAVDIVRKGGVIVYPTDSGYALGCKIEDKGAMERICRIRQLPDGHNFTLMCRDLSELSTYSFVDNVAFRLIKNNTPGNYTFILKGTKELPRRLLQEKRKTIGLRVPSNPIALALLDTLSEPMLSTSLMLPGSDFTESDPEEIKERLEKQVDLIIHGGYLGQQPTTVIDLTDDSPVVLRVGVGDVTPFL

SEQ ID NO: 14571 - DNA, 666 bp, Pseudomonas putida GB-1
  CDS (1)..(666): transl_table=11
atgaacagcctttggcgctatgaacaggacgactacgtgagccaatttttccagattcatccggagaacccacaggcgcgcttgataaaacaggccgtcgagatcatccgcaaggggggggtggtggtgtatccgacggattcggcctatgccctgggttgccagatgggcgacaagaacgccatcgagcgggtgcggcgcctgcgcgggctggacaagacgcacaacttcaccctgatgtgctgcgacatgtcgcaactgggcttgtacgccaaggtcgataccggcacttttcgcctgctcaaggcgcatgtaccggggccttacacgttcattctcaacggcacgcgtgaagtgccgcgcctgctgttgcacgacaagcgccgcaccatcgggctgcgtgtaccgaaccacgtcattaccctggccttgctggccgagttgggcgagccactgatgagcgtgagcctgatcctgccgggcgacagcgagccgatgaccgacccttacgagatccgtgagcggctggagcaccatgtcgacctggtgatcgacggcggcttcggcgacctcaaggcgtcgaccatcatcgacctgtccggtgacgagccggaactgatccgcgaaggttgcggcgaccccacgccgttcctggtcaacgcgtga

SEQ ID NO: 14572 - protein, 221 aa, Pseudomonas putida GB-1
MNSLWRYEQDDYVSQFFQIHPENPQARLIKQAVEIIRKGGVVVYPTDSAYALGCQMGDKNAIERVRRLRGLDKTHNFTLMCCDMSQLGLYAKVDTGTFRLLKAHVPGPYTFILNGTREVPRLLLHDKRRTIGLRVPNHVITLALLAELGEPLMSVSLILPGDSEPMTDPYEIRERLEHHVDLVIDGGFGDLKASTIIDLSGDEPELIREGCGDPTPFLVNA

SEQ ID NO: 14573 - DNA, 636 bp, Acinetobacter sp. ADP1
  CDS (1)..(636): transl_table=11
atgaaggagtatccagatatgttgcatttacatatacatccagacaatccacaggcacgcttaatcaatcaggctgtcgaacgcatacgtgcaggtgatgtggtggtttacccaaccgatgctgcctactcgattggttgccaaatcgggaataaatctgcaatggaacgtattgcacagattcgtggtttaggaccaaaacatcaatacgccattatgtgttgtgatttatccgatatcgcaacatatgccaaagtcgacaatgcaatgtatcgtttgcttaaagccaatacgccatcgatcaccacgtttattttgcctgcaaccagtgaagtccctaaacggttaatgcatcctaagaaaaaaaccattggattacgtattccaactaatccaatttgtcaggctttacttcaagaactgggcgaacccattctaaccagtaccctgattttaccaggtcaaagtgatccactggatgatccttatgatattgaaaatcagttgggtaagcgtgttgatgtatttattgatggcgggtttggtacactaagtacaaccagtattgtggatttatcaggtgaaaatccagaagtcgtgcgccatggtgcaggtgatgtcagtgcttttgaataa

SEQ ID NO: 14574 - protein, 211 aa, Acinetobacter sp. ADP1
MKEYPDMLHLHIHPDNPQARLINQAVERIRAGDVVVYPTDAAYSIGCQIGNKSAMERIAQIRGLGPKHQYAIMCCDLSDIATYAKVDNAMYRLLKANTPSITTFILPATSEVPKRLMHPKKKTIGLRIPTNPICQALLQELGEPILTSTLILPGQSDPLDDPYDIENQLGKRVDVFIDGGFGTLSTTSIVDLSGENPEVVRHGAGDVSAFE

SEQ ID NO: 14575 - DNA, 621 bp, Pectobacterium atrosepticum SCRI1043
  CDS (1)..(621): transl_table=11
atgagccagtttttctatattcacccacagaatccgcagccgcgattgattaatcagtcggtcgagtttttgcataaaggtggggtgattgtttatccaacggattccggttatgcgttgggctgtatgttgggcgaaaagaacgcgttggaacgcatctgtcggattcgcgatctgggtagcgatcataacttcacgctgatgtgccgcgatttgtcagaactatcgacgtatgcccatgttgataacgcggccttccggttgattaaaaataatacgccgggaaattacacgtttattctgaaagcgacaaaagaggttcctcgccgcttaatgaatgacaaacgcaaaactatcggtctgcgtgtgccgtctaatcctattgcactggatctgctggccgcgctgaatgaacctctgatgtcgacaacgctgatgctgcagggaaatgattttgctgaatccgatccagaggaaattcaggaaagattgggaaaactggtggatttgattattcacggcggttctcttggtcaacagcctacgacggttatcgacttgaccgagtccgtaccgcgcgttgcccgtgaaggtactggcgacgttacgccgttcttataa

SEQ ID NO: 14576 - protein, 206 aa, Pectobacterium atrosepticum SCRI1043
MSQFFYIHPQNPQPRLINQSVEFLHKGGVIVYPTDSGYALGCMLGEKNALERICRIRDLGSDHNFTLMCRDLSELSTYAHVDNAAFRLIKNNTPGNYTFILKATKEVPRRLMNDKRKTIGLRVPSNPIALDLLAALNEPLMSTTLMLQGNDFAESDPEEIQERLGKLVDLIIHGGSLGQQPTTVIDLTESVPRVAREGTGDVTPFL

SEQ ID NO: 14577 - DNA, 669 bp, Propionibacterium acnes KPA171202
  CDS (1)..(669): transl_table=11
gtgtactttgctggctcgctgaggccgttgcagcgatacaatgatgaggtgtctaagtattttccggtccacccggagaacccgcagcagcgttctctcaatcagatcgtcgacatcctgcaccatggcggtcttatcgcctacccgacagacacgggttatgccttcggtgcccggctagggaataaggatgccgtggaccggattcgcaaacttcgccagttatctgacaagcatcacttcaccctggtcatgagccagtttgcgcaggttggccagtatgtccagatggataactgggtgtttcgtgccgtcagtgccgctgtgccagggcgatataccttcattctcaatgccactcgtgatgttccgaaggtcatgctgcacccgcgaaagaaaaccgttggggtgcgcgttcccgagcatgtgacagccctggccctgctggaagcattgaatgagcccattgtctcctccaccctcatcctgcccggtcaggacacacctatggtcgacggttggcaggttcaagacgagatcggtgaccaactcgatgctgtcctcgactcaggggactgtggcgtcgaaccgactacggtggttgacttcacctccggtgaggcggtcgtcacccgtcggggtgccggggacccctcacttttcgaatga

SEQ ID NO: 14578 - protein, 222 aa, Propionibacterium acnes KPA171202
MYFAGSLRPLQRYNDEVSKYFPVHPENPQQRSLNQIVDILHHGGLIAYPTDTGYAFGARLGNKDAVDRIRKLRQLSDKHHFTLVMSQFAQVGQYVQMDNWVFRAVSAAVPGRYTFILNATRDVPKVMLHPRKKTVGVRVPEHVTALALLEALNEPIVSSTLILPGQDTPMVDGWQVQDEIGDQLDAVLDSGDCGVEPTTVVDFTSGEAVVTRRGAGDPSLFE

SEQ ID NO: 14579 - DNA, 612 bp, Desulfotalea psychrophila LSv54
  CDS (1)..(612): transl_table=11
atgctacttgaaattaatccatacaatccacaggataggctgataaagcaagttgtccaaaaactgcaacagggtgccattatctgctaccctacagataccggctatggtatcggctgcgatctgttaaaccagcgcgcagtcaaagccttgatgcaactcaaaaaaaggccaaaaaacaaacccttttcatttatgtgctcgggactcacccacatcagtgaatatgcgcatgtctctaatactgcctacagattgcttaaaaaaaatctgccagggccatatacctttgttcttccgggtagcaaactcgtacccaaggtaatggcaaccaaacagaagactgtgggtattagagtacccgataaccccataagccaagcacttataactgctcttggcaatcccattgtcaataccagtgttcaactgggagaagacgacgagcccctagctgatccattcgaaattgatctcgccattggtaatagaattgatattatcatagacggaggatcaatctatcctgatccatcctccgtaatcgatctcaccaccgaccaacccgaaatactccgagtcggtaaaggtgatgttagtccatatcgctaa

SEQ ID NO: 14580 - protein, 203 aa, Desulfotalea psychrophila LSv54
MLLEINPYNPQDRLIKQVVQKLQQGAIICYPTDTGYGIGCDLLNQRAVKALMQLKKRPKNKPFSFMCSGLTHISEYAHVSNTAYRLLKKNLPGPYTFVLPGSKLVPKVMATKQKTVGIRVPDNPISQALITALGNPIVNTSVQLGEDDEPLADPFEIDLAIGNRIDIIIDGGSIYPDPSSVIDLTTDQPEILRVGKGDVSPYR

SEQ ID NO: 14581 - DNA, 624 bp, Mannheimia succiniciproducens MBEL55E
  CDS (1)..(624): transl_table=11
atgagccaatttttttatattcatccggaaaatccacaagtccgattaattaatcaggccgttgatattttacgcaacggcggcgttattgtttatcctaccgattcgggttacgctttaggctgcatgattggtgataaacgcgctatggatcgaatcgtgcaaattcgtcatttgccggaagggcataattttacgttggtatgcagcgatttgtcggaactttcaacttattcgttagtgacaaacaccgcttaccgcctgataaaaaataatacgccggggcgttatacttttattttaacggcgacaaaagaattaccccgccgtttaatgacctcaaaacgcaaaactatcggtatccgtgtgcccgacaatcaaattgcgttagatttgttacgcaccttaggcgagccgattttatcctgttcattaatgttaccgaacgaggagcatattacccaatcggatccggaagaaatccgcgaccgtttggaacaccaagtggatctgattattcacggcggttatttaggtcaggaaccgacaaccgtggttgatttaaccgaagaaacgccggttattttacgtgaaggcagtggacccttagatccgtttatttaa

SEQ ID NO: 14582 - protein, 207 aa, Mannheimia succiniciproducens MBEL55E
MSQFFYIHPENPQVRLINQAVDILRNGGVIVYPTDSGYALGCMIGDKRAMDRIVQIRHLPEGHNFTLVCSDLSELSTYSLVTNTAYRLIKNNTPGRYTFILTATKELPRRLMTSKRKTIGIRVPDNQIALDLLRTLGEPILSCSLMLPNEEHITQSDPEEIRDRLEHQVDLIIHGGYLGQEPTTVVDLTEETPVILREGSGPLDPFI

SEQ ID NO: 14583 - DNA, 666 bp, Legionella pneumophila subsp. pneumophila str. Philadelphia 1
  CDS (1)..(666): transl_table=11
atgcacgcctatttggcaagaatggaacatgaaacaggggactttatgagtcagttttttgctttacatccagataatcctcaagcacgcttgttgagaaaagcagtttcaattattgaagaaggggggcttatcgtttacccgacagattctggctatgctttgggctgtagtttgggcaataaatcagccctggagcgtattcgccgcttacgccaattggataagcatcataatatgaccctggtttgtcgtgacttatcccagttaggtacttatgcaaaggtttctaatccaatttttagattattgaaggcttttactccaggctcttatacctttattcttaatgctacacatgaagtgcctcgtttgatgctccacccaaaacgaagaacattggggttaagagtacctgataacacgattactttgtctttattggagtgtctggaagcccctttaatgagcaccactttaattttaccaggagctgaagcgccattaagcgagcctgaagcaattaaagatttattaggcaaccaaattgatttaataattgatggtggaaattgtggtcatgaacccactacagtagtagatttaactggagattatccgataattataagagagggaaaaggagatcctgaaccctttaagtaa

SEQ ID NO: 14584 - protein, 221 aa, Legionella pneumophila subsp. pneumophila str. Philadelphia 1
MHAYLARMEHETGDFMSQFFALHPDNPQARLLRKAVSIIEEGGLIVYPTDSGYALGCSLGNKSALERIRRLRQLDKHHNMTLVCRDLSQLGTYAKVSNPIFRLLKAFTPGSYTFILNATHEVPRLMLHPKRRTLGLRVPDNTITLSLLECLEAPLMSTTLILPGAEAPLSEPEAIKDLLGNQIDLIIDGGNCGHEPTTVVDLTGDYPIIIREGKGDPEPFK

SEQ ID NO: 14585 - DNA, 624 bp, Methylococcus capsulatus str. Bath
  CDS (1)..(624): transl_table=11
atggcgcaatatttcgaggtgcattcccacacgccgcagcagcggctgatccgccaggccgcggagatcgtccgccaggggggggtgatcgtctatccgaccgattcgtcctatgccttcggctgtcagctggaccgcaaggatgccctgcatcgcatccgcaccatccgccagctggacgaggagcataacttcacgctgatctgccacgatctttcccaggtatcggctttcgcccggatcaacaacgaagctttccgtctgatcaagaccttgacgccagggccctatactttcctgctggaggccacgcgcgaggtgccgcgccgcctccagcatcccaagcgcaagaccatcgggatccgcctgcccgacaacgcggtttcgcagatgctggtggctgagctgggtgaacccctgttcagctcgaccctgatcctgccaggcgagaccgaaggactcgccgatcccgaggacatccgggagcgagtggggacgcgggtggaactgatcctcgccgcgggcgtcatacccttcgcggagaccacgatcgtcgacctgaccggcgagtttccggtcatcgttcgccagggcaaaggcagtatcggcttcctgcgcgcctag

SEQ ID NO: 14586 - protein, 207 aa, Methylococcus capsulatus str. Bath
MAQYFEVHSHTPQQRLIRQAAEIVRQGGVIVYPTDSSYAFGCQLDRKDALHRIRTIRQLDEEHNFTLICHDLSQVSAFARINNEAFRLIKTLTPGPYTFLLEATREVPRRLQHPKRKTIGIRLPDNAVSQMLVAELGEPLFSSTLILPGETEGLADPEDIRERVGTRVELILAAGVIPFAETTIVDLTGEFPVIVRQGKGSIGFLRA

SEQ ID NO: 14587 - DNA, 630 bp, Azoarcus sp. EbN1
  CDS (1)..(630): transl_table=11
atggctcaatatttcgcacttcatcccgagcagcctcaaccccgactgatccggcaagctgccgaaatcatgcgctcgggcggcctggtgacgtttccgaccgattccgcatatgcgctgggtggcctggccggggacgcgagcgtgctgctgcgcatccgcaggatccgcggggtcgacgagcggcaccatttcacgctgatgtgccgcgacctctccgaaatcgcaacctatgcgcgggtcgataacatgcagtatcgcttgctgaaggcaacgactcccgggccctacacgttcatcctcgagggcacgaaggaactgccgcggcgggtcctgcatccgaagcgcaagacgatcggcctgcgagttcccgaccatccggtggtcgccgcgctgctcgccgaactggacgagccgatcctgacttcgacgctgctgctgccgggcgaggaccttccgctgaccgacgccgaggaaattcgcgaccgcatggaaaaacaggtggaactggtcatcgaagcgggtttctgcgggccggaggcaacgacggtcctcgatctgacttccggcgtcccggtgctcgttcgggcggggaaaggcgatttgtcaccgttcggtctcgaggcatag

SEQ ID NO: 14588 - protein, 209 aa, Azoarcus sp. EbN1
MAQYFALHPEQPQPRLIRQAAEIMRSGGLVTFPTDSAYALGGLAGDASVLLRIRRIRGVDERHHFTLMCRDLSEIATYARVDNMQYRLLKATTPGPYTFILEGTKELPRRVLHPKRKTIGLRVPDHPVVAALLAELDEPILTSTLLLPGEDLPLTDAEEIRDRMEKQVELVIEAGFCGPEATTVLDLTSGVPVLVRAGKGDLSPFGLEA

SEQ ID NO: 14589 - DNA, 705 bp, Neisseria gonorrhoeae FA 1090
  CDS (1)..(705): transl_table=11
atgccgtctgaaaggttttcagacggcattttgtttggcgtttgggcgtacaatacggaaaacatgacgataaggaaacaaactatggcacaatttttcgccgttcatcccgacaatccccaagaacgcctcatcaagcaggcagtcgaaatcatcaatcaaggcggcgtggtggtttatccgaccgattcctgttacgccttgggttgcaaactcggcgataaggcggcgatggaacgcatactctccatccgaaaaatcgatttgaaacaccacctgaccctgatgtgcgccgatttgagcgagttgggcacatacgccaaaatcgacaacgtacagtttcgtcagcttaaagccgccacgcccgggccttatacctttatcttgcaggcgacgaaggatgcgccggcgcgcgccctgcacccgaaacgcaaaaccatcgggctgcgtattcccgataatgccgttgcacaagccctgctggaggagttgggcgggccgcttttaagctgcaccctgatgctgcccgaagacggcgaaccattgaccgacccttatgaaatccgcgagcgtttggaacacgccgtcgatttggtgattgacggcggctggtgcggaaccgatccgactaccgtcatcgacatgaccgacggcacggaactggtgcgccggggtttcggcgatacggcggtgttcggtttgtag

SEQ ID NO: 14590 - protein, 234 aa, Neisseria gonorrhoeae FA 1090
MPSERFSDGILFGVWAYNTENMTIRKQTMAQFFAVHPDNPQERLIKQAVEIINQGGVVVYPTDSCYALGCKLGDKAAMERILSIRKIDLKHHLTLMCADLSELGTYAKIDNVQFRQLKAATPGPYTFILQATKDAPARALHPKRKTIGLRIPDNAVAQALLEELGGPLLSCTLMLPEDGEPLTDPYEIRERLEHAVDLVIDGGWCGTDPTTVIDMTDGTELVRRGFGDTAVFGL

SEQ ID NO: 14591 - DNA, 669 bp, Pseudomonas syringae pv. syringae B728a
  CDS (1)..(669): transl_table=11
atgaacagcctactgcctccgtctgaacaggaagtaatcgtgagtcaatttttccaggtccatccggaaaacccgcagccgcgcctgatcaaacaggccgctgaaatcatcaaggccggcgggctggtggtgtacccgacagattcgtcctatgcactgggttgccagatcggtgacaagagcgccatcgagcgtatccgccgcctgcgccagctggacgacaagcacaacttcaccctgatgtgctgtgatctgtcgcaactggggctgtttgccaaggtcgacaccggcgcgttccgcgcactgaaggcgcacacgccagggccatacaccttcattctcaacgccacccgcgaggtgccgcgtctggtgctgcaccccaagcgccgcaccatcggcctgcgtgtgccaagccatcccatcgcccaggccctgctggagcaattgggcgagccgctgatgagcgtcagcctgatcatgccgggcgacagcgtgcccctcagcgatccctatgagatgcgccaggttctcgagcatcaggtcgacctgatcatcgatggcgggatcggcggtatttcggcgtccacggtcattaacctggctgagggtgaaccccagatcgttcgggttggttgcggtgatccgacgcctttcggtgaacgcgcctga

SEQ ID NO: 14592 - protein, 222 aa, Pseudomonas syringae pv. syringae B728a
MNSLLPPSEQEVIVSQFFQVHPENPQPRLIKQAAEIIKAGGLVVYPTDSSYALGCQIGDKSAIERIRRLRQLDDKHNFTLMCCDLSQLGLFAKVDTGAFRALKAHTPGPYTFILNATREVPRLVLHPKRRTIGLRVPSHPIAQALLEQLGEPLMSVSLIMPGDSVPLSDPYEMRQVLEHQVDLIIDGGIGGISASTVINLAEGEPQIVRVGCGDPTPFGERA

SEQ ID NO: 14593 - DNA, 624 bp, Haemophilus influenzae 86-028NP
  CDS (1)..(624): transl_table=11
atgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaacggtaaataataccgcttatcgtttgattaaaaataatacgccagggcgttatacttttattcttacagcaacgaaagaattacctcgccgtttaatgacatcaaaacgtaaaaccattggtttacgcgtaccagataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaa

SEQ ID NO: 14594 - protein, 207 aa, Haemophilus influenzae 86-028NP
MSQFFYIHPENPQARLINQAVEILQKGGVIVYPTDSGYALGCMMGDKHAMDRIVAIRKLPEGHNFTLVCSDLSELSTYATVNNTAYRLIKNNTPGRYTFILTATKELPRRLMTSKRKTIGLRVPDNKIALDLLSALGEPILSCSLMLPNEEHTTQSDPEEIRDRLEHQVDLIIHGGYLGQEPTTVVDLTEESPVILREGSGSTAPFI

SEQ ID NO: 14595 - DNA, 654 bp, Pseudomonas fluorescens Pf-5
  CDS (1)..(654): transl_table=11
ttgccgcctgaacaggtagagacagtgagtcaatttttccagatccacccggaaaacccccagccacgcctgatcaaacaggccgtcgagatcattcgcggcggcggtgtggtgatctatcccacggattcgtcctacgccgtcgcctgccagatgggcgacaagggcgcaatcgaacgggttcgacgcctgcgccagctggacgacaagcacaacttcgcgctgatctgcagcgacctttcgcagttgggcctgttcgccaagatcgacacgggcactttccgtctgctcaaggcccatgtgccggggccctacaccttcattctcaacgccacccgggaagtgccgcgcctgctgctgcaccccaagcgccggaccatcggcctgcgggtgccgagcaacccgatcgccctggcgctgctggccgagctgggcgagccgctgatgagcgtcagcctgatcatgcccggtgataccgaggccctgagcgatccctacgagatgcgccagttgctggagcaccaggtggacctgatcatcgatggcggtttcggcagcaccgagtcgtccacggtgatcaacctcgccgacggcgagccggaagtgatccgcgtcggttgcggcgaccccgcgccgttcatggccgaggcctag

SEQ ID NO: 14596 - protein, 217 aa, Pseudomonas fluorescens Pf-5
MPPEQVETVSQFFQIHPENPQPRLIKQAVEIIRGGGVVIYPTDSSYAVACQMGDKGAIERVRRLRQLDDKHNFALICSDLSQLGLFAKIDTGTFRLLKAHVPGPYTFILNATREVPRLLLHPKRRTIGLRVPSNPIALALLAELGEPLMSVSLIMPGDTEALSDPYEMRQLLEHQVDLIIDGGFGSTESSTVINLADGEPEVIRVGCGDPAPFMAEA

SEQ ID NO: 14597 - DNA, 624 bp, Psychrobacter arcticus 273-4
  CDS (1)..(624): transl_table=11
atgcaagtattttatattcatccagaaaatccgcagccgaggctgattgaacaagtagcaaacttattacgtaaggatcaattaatcatttatccgactgacactagttatgcttttggctgtcgcttaggcgcaaaagacgcgttagagaagcttaaacatattcgtgagcttgatgataagcatcaatttaccttactttgtcgtgatttaagtgagattgccaattacgctgcggtagacaatgtacaatttaaacagcttaaagcacatacacccgcacctattacctttattttgaatgctaccaaagatgtaccaaagaaactggcgcatgcgaagaaaaaaaccattggtattcgcgtaccaagcaatgctatagctcaagcgttattagaggcgatggatgagcctattttgaccagctcattaatattgccaaaccgagataacatactagatgacccttttgagatcgaagaattattgggtaatcagatagatgggctaatcaatgctggcatcaaaaccacaaagctcacgaccatcgttgatatgaccagtagccagcctgaagtaatccggcaaggtgccgctgatgtggattcattattgtatagttga

SEQ ID NO: 14598 - protein, 207 aa, Psychrobacter arcticus 273-4
MQVFYIHPENPQPRLIEQVANLLRKDQLIIYPTDTSYAFGCRLGAKDALEKLKHIRELDDKHQFTLLCRDLSEIANYAAVDNVQFKQLKAHTPAPITFILNATKDVPKKLAHAKKKTIGIRVPSNAIAQALLEAMDEPILTSSLILPNRDNILDDPFEIEELLGNQIDGLINAGIKTTKLTTIVDMTSSQPEVIRQGAADVDSLLYS

SEQ ID NO: 14599 - DNA, 621 bp, Colwellia psychrerythraea 34H
  CDS (1)..(621): transl_table=11
atgagtcagtttttttatgtacaccctgataatccgcaaggtcgtttaatgaagcaagcggcagatattattaagcaaggcggggtcattgtttaccctacagattcaggctacgcattaggttgtcacttaggtgataaaaaagcattagagcgtatctgtcgcattagagacatagataaagatcataactttaccttagtttgccaagatctatcacaaatatcagaatatacacgggtagataacacagcttatcgattactaaaaagtaatactccgggcgcttacacctttatctttaaaggtagtaaagaagtccctaagcgactgttaaaccctaaaaagaaaacaataggcataagagtgcctgataatactattgcacaagccttgttgactgaacttgcagagcctataatgtctaccagtttaattatgcctggccaagaaatggctgagtatgatcctgaacaaattcgagatttgttagaacatcaagttgaccttatcgtcaatggtggttatttaggggagcaccctaccactgtgattgatttttctaatgacagtattgagataatacgcgtgggagagggtgatcctactccatttcaataa

SEQ ID NO: 14600 - protein, 206 aa, Colwellia psychrerythraea 34H
MSQFFYVHPDNPQGRLMKQAADIIKQGGVIVYPTDSGYALGCHLGDKKALERICRIRDIDKDHNFTLVCQDLSQISEYTRVDNTAYRLLKSNTPGAYTFIFKGSKEVPKRLLNPKKKTIGIRVPDNTIAQALLTELAEPIMSTSLIMPGQEMAEYDPEQIRDLLEHQVDLIVNGGYLGEHPTTVIDFSNDSIEIIRVGEGDPTPFQ

SEQ ID NO: 14601 - DNA, 630 bp, Pseudomonas syringae pv. phaseolicola 1448A
  CDS (1)..(630): transl_table=11
gtgagtcaatttttccaggtccatccggaaaacccgcagccgcgcctgatcaaacaggccgcggaaatcataaaagccggcgggctggtggtgtacccgacagattcgtcctatgcgctgggttgccagatcggtgacaagagcgccatcgagcgtatccgccgtctgcgtcagctggacgacaagcacaacttcaccctgatgtgctgcgacctgtcgcaactggggctttttgccaaggtcgacaccggcgctttccgcgcactcaaggcgcacacgccggggccgtacacctttattctcaacgccacccgcgaggtgccgcgcctggtgctgcaccccaagcgccgcaccatcggcctgcgcgtgccgagccaccccattgcccaggccttgctcgagcaattgggcgagccgctgatgagcgtcagcctgatcatgccgggtgacactgtgccgctcagcgatccctacgagatgcgccagattctcgagcatcaggtggacctgatcattgatggcgggatcggcggtatttcggcgtccacagtcatcaacctggctggcggagagccagaagtggttcgggttggctgcggtgatccaacgctgttcggtgaacgcgcttaa

SEQ ID NO: 14602 - protein, 209 aa, Pseudomonas syringae pv. phaseolicola 1448A
MSQFFQVHPENPQPRLIKQAAEIIKAGGLVVYPTDSSYALGCQIGDKSAIERIRRLRQLDDKHNFTLMCCDLSQLGLFAKVDTGAFRALKAHTPGPYTFILNATREVPRLVLHPKRRTIGLRVPSHPIAQALLEQLGEPLMSVSLIMPGDTVPLSDPYEMRQILEHQVDLIIDGGIGGISASTVINLAGGEPEVVRVGCGDPTLFGERA

SEQ ID NO: 14603 - DNA, 627 bp, Dechloromonas aromatica RCB
  CDS (1)..(627): transl_table=11
atggcacgcgttgtcaatattcatcccgaatctccgcagcagcgcctgctcgcccaggcagccgaatttattcgcaatggcgccatcgtcgccttgcccaccgactcctgctacgcgctgggttgtcatctcggcgacaaggaagcgctggacaagattcgcctgattcgccagatggatgatcgccatcacctgacgctgatggtccgcgacctttccgaaattgctcatttcgcccgggtcgacaatgcacagtaccgtctgctcaaggcggcgacgccgggcagctataccttcattctggaaggttccaaggaactgccgcgccgggtcatgcatccgaaacgcaagaccatcggcctgcgtgtgccggatcatccggtcgcgctggccttgcttgaagagttgaatgagccgctgctgacaacgacgctgcagttgccgggcgacgagtttccgctgaccgaaggctgggaaatccaggatcgacttgaagatcaattggagctgattctcgatgcggggccttgtggtactgagccgacaaccgtcatcgatctgaccggttcggcacccgagctgattcgcgccggccgcggtccgctcgaaatcttcggtctgggctaa

SEQ ID NO: 14604 - protein, 208 aa, Dechloromonas aromatica RCB
MARVVNIHPESPQQRLLAQAAEFIRNGAIVALPTDSCYALGCHLGDKEALDKIRLIRQMDDRHHLTLMVRDLSEIAHFARVDNAQYRLLKAATPGSYTFILEGSKELPRRVMHPKRKTIGLRVPDHPVALALLEELNEPLLTTTLQLPGDEFPLTEGWEIQDRLEDQLELILDAGPCGTEPTTVIDLTGSAPELIRAGRGPLEIFGLG

SEQ ID NO: 14605 - DNA, 624 bp, Ralstonia eutropha JMP134
  CDS (1)..(624): transl_table=11
atgtcccagtacttcgaaatccatccgcagaacccgcagccgcggcttatcaagcaggcggtgcagatcatccgccagggcgggctgatcgcgctgccgaccgactccagttacgcgctgggctgccagcttgacgacaaggccgccgtggagcgcctgcgccggctgcgcggcatcgacgacaagcaccacctcacgctgatgtgcagcgacctgtccgagctgggcagtttcgcgcgcgtcgacaaccggcagtaccgctggatcaagggcgctacgccgggcccttatgtcttcatcctggaggccaccaaggaggtgccgcggcggctgtcgcacccgtcgcgaaagaccatcggcgtgcgcgtgcccgagcacgccatcccgctggcgctgctggccgacgccggcgagccgctgctgacggccacgcttcagttgcccggcgacgaggagccgatgaacgaccccgcggaaatccgtgccaggcttgaaaagctgctggatctcgtcatctgcggcggcccggcgccggcacagcccacgaccgtgattgacctgaccagtggagagcccgagctcgtgcgccagggaaggggcgatatcgcacggttcggtctctga

SEQ ID NO: 14606 - protein, 207 aa, Ralstonia eutropha JMP134
MSQYFEIHPQNPQPRLIKQAVQIIRQGGLIALPTDSSYALGCQLDDKAAVERLRRLRGIDDKHHLTLMCSDLSELGSFARVDNRQYRWIKGATPGPYVFILEATKEVPRRLSHPSRKTIGVRVPEHAIPLALLADAGEPLLTATLQLPGDEEPMNDPAEIRARLEKLLDLVICGGPAPAQPTTVIDLTSGEPELVRQGRGDIARFGL

SEQ ID NO: 14607 - DNA, 624 bp, Thiobacillus denitrificans ATCC 25259
  CDS (1)..(624): transl_table=11
atggcgcaatacttcaatgttcatgccgagaatccgcagccgcgcctgatccagcagacggtcgacatcctcaagcgcggcggcgtcatcgtctatcccaccgattcctgctacgcgctcggctgtcacatcggcgacaaggaggcggcgatgcggctgctgtcggtgcgcgggctcgacaccgggcacgacctcacgctcgtgtgtcgcgacctgtccgaactcggccgctacgcccaggtcgacaacgcgcagttccgcctgctcaaggcccacacccccggcccctataccttcatcctgcgcggcacgcgcgaggtgccgcgccggctgctgcacaagaggcacgacacgatcggcctccgggtgcctgcgcatccgctcgtccaggcgttgctcgaagggctcggcgagccgatcctgtcatcgacgctgctgctgtacggcgaggacgtgcccttgaccgagccctgggaaatccgcgagcgcctcgagcatcaggtcgatctggtcatcgacggcggcgcctgcggcctgacgccgacgacggtcgtcgacctgacggccgagacgccggccgtcgtgcgctatggcaagggcgaggcttcggccttcgaagcctga

SEQ ID NO: 14608 - protein, 207 aa, Thiobacillus denitrificans ATCC 25259
MAQYFNVHAENPQPRLIQQTVDILKRGGVIVYPTDSCYALGCHIGDKEAAMRLLSVRGLDTGHDLTLVCRDLSELGRYAQVDNAQFRLLKAHTPGPYTFILRGTREVPRRLLHKRHDTIGLRVPAHPLVQALLEGLGEPILSSTLLLYGEDVPLTEPWEIRERLEHQVDLVIDGGACGLTPTTVVDLTAETPAVVRYGKGEASAFEA

SEQ ID NO: 14609 - DNA, 660 bp, Anabaena variabilis ATCC 29413
  CDS (1)..(660): transl_table=11
atggcaaaaattatcgctgtccatcctgataatccccagagtcgcagaatagaggaaataaggtcagcgctttccagtggcgcggtgatgctttatccaactgacacagtttatgcgatcggttgtgatttaaatgtcaagtctgcggtggaaagagtgcggcaaatcaagcagttagcaaacgataaaccactgacatttttatgtccttcactgtctaatgtagctacttatgcctttgtcagtgatacagcttatcgaattatgaagcgactaataccaggaacttacacatttttgttacctgcaactaagttggtaccaaaattagtccaaagtcccaagcgtaaaactactggaattcgcgtaccaaatcatactgtatgtttagcattacttgaagccttggggaatccgattatttccacttcagcacacataccgccagatgaggcaggtaatgggaaagtcgggatagtttcagaatcgattacctcaatggcagagctatttgaccgcgtggataaattagttgatgtgattgtagacactggacaggaaccaacttacgatgtgtccacaatcgttgatttgacgggagatgaaccaatgattactagacaaggattaggttgggaagcggtaaaagcgtgggtataa

SEQ ID NO: 14610 - protein, 219 aa, Anabaena variabilis ATCC 29413
MAKIIAVHPDNPQSRRIEEIRSALSSGAVMLYPTDTVYAIGCDLNVKSAVERVRQIKQLANDKPLTFLCPSLSNVATYAFVSDTAYRIMKRLIPGTYTFLLPATKLVPKLVQSPKRKTTGIRVPNHTVCLALLEALGNPIISTSAHIPPDEAGNGKVGIVSESITSMAELFDRVDKLVDVIVDTGQEPTYDVSTIVDLTGDEPMITRQGLGWEAVKAWV

SEQ ID NO: 14611 - DNA, 630 bp, Pseudomonas fluorescens PfO-1
  CDS (1)..(630): transl_table=11
gtgagtcaatttttccagattcatccggaaaacccgcaagcgcgcctgatcaaacaggccgtcgagatcatccgcaagggcggagttgtggtctatcccaccgactcttcctacgcaatcggttgccagatcggtgacaagaacgccatcgagcgcgttcgtcgcctgcgtcaactcgacgaaaagcacaacttcgcgctgatctgcagcgacctgtcgcaactgggcaattacgccaagatcgacaccgcgacctttcgaatcctcaaagcccacttgccgggcccgtacaccttcattctcaacgccacccgcgaagtaccgcggctgctgctgcatccgaagaagcgcaccatcggtctgcgggtgccgagccatcccatcgcgctggcgctgctggccgaactgggcgagccgctgatgagcgtgaccctgatcatgccgggcgatgaagacccgttgagcgatccgtacgaaatgcgccaggtgctcgagcatcaggtggacctgatcatcgacggcggatccggcggcatcaaggcctccaccgtgatcgacctgaccggcgatgatccggaagtgatccgcgtcggttgcggcgacccggctccattcatggtcgaggcctga

SEQ ID NO: 14612 - protein, 209 aa, Pseudomonas fluorescens PfO-1
MSQFFQIHPENPQARLIKQAVEIIRKGGVVVYPTDSSYAIGCQIGDKNAIERVRRLRQLDEKHNFALICSDLSQLGNYAKIDTATFRILKAHLPGPYTFILNATREVPRLLLHPKKRTIGLRVPSHPIALALLAELGEPLMSVTLIMPGDEDPLSDPYEMRQVLEHQVDLIIDGGSGGIKASTVIDLTGDDPEVIRVGCGDPAPFMVEA

SEQ ID NO: 14613 - DNA, 633 bp, Burkholderia sp. 383
  CDS (1)..(633): transl_table=11
atgtcccagttcttcaggattcacccggataatccgcagccgcgcctgatcaagcaggccgtggaaatcgtcagcaagggcggcgtgatcgcgatgccgaccgattcgagctatgcgctcgcgtgccatctcgacgacaaggacgcggtcgagcgcgtgcgccggattcgcggcctcgacgagaagcagcacctgtcgctgctcgtgcgcgacctgtcggagctcgccaacttcgcgatggtcgataaccgccagtaccgtcagatcaagtcggtgacacccggcccgtacgtcttcatcctgcaggcgacgaaggaggtgccgcgccggctgtcgcacccgtcgcgcaagacgatcgggctgcgcgtgcccgatcacgcgatcacgctcgcgttgctggaatcgctcggccagccgctgctcggcacgacgctgatcctgccgccggacgacgagccgctcaacgaacccgaagaaatccgcgagcggctcgagaaacaggtcgacctcgtgatcgacggcggcgcatgcccgcgcgagccgtcgacggtgatcgacctgaccggcgaggagcccgagctcgtgcgcgcggggcgcggcgcgctcgaaccgttcgggctatcggcggcgtaa

SEQ ID NO: 14614 - protein, 210 aa, Burkholderia sp. 383
MSQFFRIHPDNPQPRLIKQAVEIVSKGGVIAMPTDSSYALACHLDDKDAVERVRRIRGLDEKQHLSLLVRDLSELANFAMVDNRQYRQIKSVTPGPYVFILQATKEVPRRLSHPSRKTIGLRVPDHAITLALLESLGQPLLGTTLILPPDDEPLNEPEEIRERLEKQVDLVIDGGACPREPSTVIDLTGEEPELVRAGRGALEPFGLSAA

SEQ ID NO: 14615 - DNA, 612 bp, Geobacter metallireducens GS-15
  CDS (1)..(612): transl_table=11
atgctccttgacattaacccccagaatcctcaaccgagactcgtcgcacaggtggtcaaaatcctcaaggatggcggcatcattgcctatccgactgacacgacctatggtatcggttgcagtattttcagcaagaaggggatcgagcggatctacctccttaagcagcgcgagaagaagaagccattctccttcatctgttccgacctgtccgaggtggcgcgctacgccaaggtcagcaattatgcttataagatgctcaagcgtcatcttcccggtccttatacttttgtccttgatgccaccagcattgttcctgatcttcttgtgaccaaacagaaaaccgttggaatcaggattccggacaaccggatctgtctttcactggtaaaagaactcggccatccgattatcactacaagcgccaacctttccggtgaagagcccatcggcgatccttaccttgtcgatctcaacatgggcaaacagcttgatgttgtcgtcgatggagggattctgtccgccgacgtcagctccgtggtaagcctcatcggtgactatccacaggtgcttcgtcaaggtgtgggcgatgtgagttggtgtgagggataa

SEQ ID NO: 14616 - protein, 203 aa, Geobacter metallireducens GS-15
MLLDINPQNPQPRLVAQVVKILKDGGIIAYPTDTTYGIGCSIFSKKGIERIYLLKQREKKKPFSFICSDLSEVARYAKVSNYAYKMLKRHLPGPYTFVLDATSIVPDLLVTKQKTVGIRIPDNRICLSLVKELGHPIITTSANLSGEEPIGDPYLVDLNMGKQLDVVVDGGILSADVSSVVSLIGDYPQVLRQGVGDVSWCEG

SEQ ID NO: 14617 - DNA, 702 bp, Synechococcus elongatus PCC 7942
  CDS (1)..(702): transl_table=11
atggcgaagcactaccgcattcatccagacagcccacaacctcagcagatcgccgcaatcgctgaagccctgcgtcagggggctgtcattctgtatccaaccgattcagtctacgcgattggttgtgatgtcaaagaccgtgcagcggtgcaacgggtgcgccggatcaaggaaattgacaatgacaagccgctgacctttatctgtccgtctctctccgtagccgcccaatacggctgcattagcgatcgcgcttttcgcttgatgcgcgaactggtgccagggccctacacctttttgctgcccgcgacgcccgaggtgccgcgcgtggtcatgaatcccaaacggcggaccgccggtattcgcattcccaacaaccccatctgccaagccctcttgcaggcgctggaaggcccaatcatctcgacctcggcacatctacagcccagcgatcgcaaagctcccttagcttacgaacaaggcccccattgcccgatcgcccccgctgaactgtttggggaggtcgatcgcctcgtcgacatcaccatcgaggtcgaacgccaggagatgcggattctcggtgccgatcctgattaccaagtgtcaactgttctcgacttgaccgatgactggcccttggtcctgcgccgaggcttgggctgggaagcccttgaaccgctgggtttgctggtcgaagcttag

SEQ ID NO: 14618 - protein, 233 aa, Synechococcus elongatus PCC 7942
MAKHYRIHPDSPQPQQIAAIAEALRQGAVILYPTDSVYAIGCDVKDRAAVQRVRRIKEIDNDKPLTFICPSLSVAAQYGCISDRAFRLMRELVPGPYTFLLPATPEVPRVVMNPKRRTAGIRIPNNPICQALLQALEGPIISTSAHLQPSDRKAPLAYEQGPHCPIAPAELFGEVDRLVDITIEVERQEMRILGADPDYQVSTVLDLTDDWPLVLRRGLGWEALEPLGLLVEA

SEQ ID NO: 14619 - DNA, 630 bp, Burkholderia thailandensis E264
  CDS (1)..(630): transl_table=11
atgtcccaattcttcaggattcacccggatgatccgcagccgcgtctcatcaagcaggcggccgaaatcgtgcgcggcggcggcgtgatcgcgctgccgaccgattctagctacgcgctcgcgtgccatctggacgacaaggacgcggtcgagcgcgtgcgccgcatccgcgggctcgacgagaagcagcacctgtcgctcctcgtgcgcgatctgtccgagctcgcgacgttcgcgatggtcgacaaccgccagtaccggctgatcaagtcggtgacgccggggccgtacgtgttcatcctgcaggcgacgaaggaagtgccgcggcggctgtcgcacccgtcgcgcaagacgatcggcctgcgcgtgcccgcgcatgcgatcacgctcgcgctgctcgagtcgctcggccagccgctgctcggcacgacgctgatcctgccgcccgacgacgaaccgctcaacgatccggaggaaatccgcgcgcgcctcgaaaagcaggtcgacctcgtgatcgacggcggcgcgtgcccgcgcgagccgtcgacggtgatcgacctgacgggtgacgagccgcaactcgtgcgggcggggcgcggcccgctcgagccgttcggcctcgccgcgtga

SEQ ID NO: 14620 - protein, 209 aa, Burkholderia thailandensis E264
MSQFFRIHPDDPQPRLIKQAAEIVRGGGVIALPTDSSYALACHLDDKDAVERVRRIRGLDEKQHLSLLVRDLSELATFAMVDNRQYRLIKSVTPGPYVFILQATKEVPRRLSHPSRKTIGLRVPAHAITLALLESLGQPLLGTTLILPPDDEPLNDPEEIRARLEKQVDLVIDGGACPREPSTVIDLTGDEPQLVRAGRGPLEPFGLAA

SEQ ID NO: 14621 - DNA, 609 bp, Syntrophus aciditrophicus SB
  CDS (1)..(609): transl_table=11
atgctgttatcgataaacactcagaaccctcagacaagacttatcaagaaggttgccgaaattctgcgtgacggaggaatagttatctatccaactgatacggtatatggccttggatgcaatcttttcaacaaaaaaggcatcgagaagatttacgaaatcaagaaaagaaacaaaaagcagcccctcagctttatctgcgccgaccttaaggatatcagcaaatatgcccaggtaaccgatttcggttacaggataatgaagcgtcatcttccgggcccttacactttcattcttcaagcctcgagactcgtcccgaagatcattcttcccaaaagacagacaactgggattcgtgtaccggacaacaggatctgcatggctctggttgctgaactgggccaacccatcatcagcaccagcgtgaaggcggctgatgatcgatatctgaatgatccggaagagattgaaagtatattcaagcatcacgttgatgtcattatcaatgggggcatcattgcagctgaaccttccaccatcgtcagcctgatcgatgataccgtggaagttttgagaatcggcaaaggagatgcttcggaatttatatag

SEQ ID NO: 14622 - protein, 202 aa, Syntrophus aciditrophicus SB
MLLSINTQNPQTRLIKKVAEILRDGGIVIYPTDTVYGLGCNLFNKKGIEKIYEIKKRNKKQPLSFICADLKDISKYAQVTDFGYRIMKRHLPGPYTFILQASRLVPKIILPKRQTTGIRVPDNRICMALVAELGQPIISTSVKAADDRYLNDPEEIESIFKHHVDVIINGGIIAAEPSTIVSLIDDTVEVLRIGKGDASEFI

SEQ ID NO: 14623 - DNA, 624 bp, Saccharophagus degradans 2-40
  CDS (1)..(624): transl_table=11
gtggcgcagtttttctcgattcacccagaaaaccctcaggcgagattgatttcgcagtcggttgatattgttcgacgtggaggccttatcgcttacccaacggattctgcctacgcattaggctgtcatattggcgataagcttgccctagatcgtatacgcgctattaggcagctagataaagatcataacttcactttaatgtgccgagacttgtctgaattggctaactacgccaaagtcgataatgctgtgtttagattgatcaaaagccatacgccaggtgcttacacttttattttaccggcaacgtctgaagtgccgcgccgattaatgcatcccaagcgtaaaacccttggtttgcgtgtgcctaataaccctatcgctttggcgttaatggatgccttgggtgagccgttaatgagcagttcgcttattttgccaggcgataccgtgcctctaaccgacccttatgacattcgcgagtcgcttgagcaccagctagagctagtgatagacggtggctactgtgggatggagccaactacggtggtggatttgacgggcgatgagcctgtggtaacccgcgtgggctgtggcgatccctcgccgtttactttctag

SEQ ID NO: 14624 - protein, 207 aa, Saccharophagus degradans 2-40
MAQFFSIHPENPQARLISQSVDIVRRGGLIAYPTDSAYALGCHIGDKLALDRIRAIRQLDKDHNFTLMCRDLSELANYAKVDNAVFRLIKSHTPGAYTFILPATSEVPRRLMHPKRKTLGLRVPNNPIALALMDALGEPLMSSSLILPGDTVPLTDPYDIRESLEHQLELVIDGGYCGMEPTTVVDLTGDEPVVTRVGCGDPSPFTF

SEQ ID NO: 14625 - DNA, 630 bp, Methylobacillus flagellatus KT
  CDS (1)..(630): transl_table=11
ttggcgcaatatttcgtgattcatcctgaaaacccgcagccacgcctgatcaaccaggcggttgccatcctgcgcgatggtggcgtgatcgcctatcccaccgattccagctatgcgctggggtgcatgctgggaaacaaggaggcacaggaccgcattcgtgccatccgcggtgtggacgacagccatcattttacgctgatctgccgtaatctggccgagctttccacctatgctcaggtagacaacagccagttccggttgctgaaagccaatacgccgggacaatacactttcattctcaaggccacgcgcgaagtcccgcgccgattgcagcatcccaaacgcagcaccgtgggcttgcgggtgccgcagcatgctgtcacgctggcattgctggaagaattgaacgagcctatgctgagcatgacgctgcaattgcctggagatgatgcgccgctcaacgaagcctgggaaatccgcgaccagctagaacatcaggtggatctcgtcatcgatgctggcgcatgcgcattcaagccgacgacggtgatcgacctgaccggggaaagtcccagcctggtccgcctgggtgcgggcgacccggcgccattcggcctggaggcatga

SEQ ID NO: 14626 - protein, 209 aa, Methylobacillus flagellatus KT
MAQYFVIHPENPQPRLINQAVAILRDGGVIAYPTDSSYALGCMLGNKEAQDRIRAIRGVDDSHHFTLICRNLAELSTYAQVDNSQFRLLKANTPGQYTFILKATREVPRRLQHPKRSTVGLRVPQHAVTLALLEELNEPMLSMTLQLPGDDAPLNEAWEIRDQLEHQVDLVIDAGACAFKPTTVIDLTGESPSLVRLGAGDPAPFGLEA

SEQ ID NO: 14627 - DNA, 636 bp, Burkholderia xenovorans LB400
  CDS (1)..(636): transl_table=11
atgtcccgatacttccggcttcatcccgacaacccgcagccgcgcctcgtcaagcaggccgtgcagatcatcaaggatggcggcgtggtcgcgctgccgacggactccagctacgcgctcgcctgccacctggacgacaaggacgcggtcgagcgtctgcggcgcattcgcggactggacgagaagcagttgctgtcgctgctggtgcgcgatctgtcggaactttcgaatttcgcgatggtagacaaccggcagtaccggctgatcaaatcggtgacgcccggcccgtacgtattcgtgttgcaggccaccaaggaggtgccgcggcgcctctcgcacccgtcgcgcaagaccatcggcctgcgcgtgccggatcacgcgatcacgctggcgattctcgaggaactcggccagccgctgctcggctccacgctgatcatgccgggcgaaacccagccgctgaacgacccggaggaaattcgcgcgcgcctggaaaagcagctggatctggtgatcgacggcggtccttgcgtatgcgagccttccacggtgatcgatctgaccggtgcggaaccggtgctggtgcgggcagggcgcggttctctcgcgccgttcggcctcgcagagacggcatga

SEQ ID NO: 14628 - protein, 211 aa, Burkholderia xenovorans LB400
MSRYFRLHPDNPQPRLVKQAVQIIKDGGVVALPTDSSYALACHLDDKDAVERLRRIRGLDEKQLLSLLVRDLSELSNFAMVDNRQYRLIKSVTPGPYVFVLQATKEVPRRLSHPSRKTIGLRVPDHAITLAILEELGQPLLGSTLIMPGETQPLNDPEEIRARLEKQLDLVIDGGPCVCEPSTVIDLTGAEPVLVRAGRGSLAPFGLAETA

SEQ ID NO: 14629 - DNA, 648 bp, Ralstonia metallidurans CH34
  CDS (1)..(648): transl_table=11
atgtcccaatacttcgagattcatcccgacaatccgcaggcgcgactggtcaagcaggccgcgcagatcgtgcgccagggcggcctgatcgcgctcccgactgactcgagttacgcgctggcttgccagatcgacgataaggccgccgtggagcagttgcgccgtctgcgcgagatcgacgagaagcatcacctgacgctgatgtgcagcgatttgtccgaacttggcaatttcgcccgggtggacaaccgccagtaccgctggatcaagggcgcgacgcccggaccgtatgtgttcatcctggaggcgacgaaggaagtgccgcgcaggctgtcgcacccggcgcgcaagaccatcggcgtgcgcgtgcccgagcatccgattccattggcgctggtggccgaattgggtcagccgctgatttccgccacgctgcagttgccgggcgacgacgcgccgatgaacgacccggcagagatccgggcgcgtctggaaaagcgcctcgacctggtgatcgacggtggtccggcgccggctcagccgaccacggtcatcgatctgaccagcggcgagccagttctggtgcgggcgggcaggggcgatgtggagcgcttcggcctgaatgcgtcggacttcgccacgacctga

SEQ ID NO: 14630 - protein, 215 aa, Ralstonia metallidurans CH34
MSQYFEIHPDNPQARLVKQAAQIVRQGGLIALPTDSSYALACQIDDKAAVEQLRRLREIDEKHHLTLMCSDLSELGNFARVDNRQYRWIKGATPGPYVFILEATKEVPRRLSHPARKTIGVRVPEHPIPLALVAELGQPLISATLQLPGDDAPMNDPAEIRARLEKRLDLVIDGGPAPAQPTTVIDLTSGEPVLVRAGRGDVERFGLNASDFATT

SEQ ID NO: 14631 - DNA, 612 bp, Myxococcus xanthus DK 1622
  CDS (1)..(612): transl_table=11
atggccgcacccatcctcgaggtggacacggagcacccatcaccccgccacatccagcgagcggtggaggtgctggagcgcggcggcctgctggcctacccgacggacacgtacttcgggctcggctgcgacttgagctccaagaagggcatcgagcggctgtaccagctcaagggacgcgacaagaagaagcccctgtcctttctctgccccgacctgtcggacgtggcgcgctacgcgcacgtgagcaacttcgcgtaccggaccatgaagagcctcactccgggtgcgttcaccttcatcctggaagcgacgcgtctggtgccggacctgatgatgtccaagcagaagcaggtgggcatccgggtgccggactccgcgctcgttcgcgagctgacccgagccctgggccgccctctggtgacgacctccgcgaccaatacggagggtgagcccctcacggacgcaaaggatatcaaggccgatctgggacacggcctggacctcatccttgacgggggcgtgacgctcaatgaaccgtcgaccgtgatttcactcatcggcgattcacttgaaatcctccggcaggggaagggtaggctggaggactag

SEQ ID NO: 14632 - protein, 203 aa, Myxococcus xanthus DK 1622
MAAPILEVDTEHPSPRHIQRAVEVLERGGLLAYPTDTYFGLGCDLSSKKGIERLYQLKGRDKKKPLSFLCPDLSDVARYAHVSNFAYRTMKSLTPGAFTFILEATRLVPDLMMSKQKQVGIRVPDSALVRELTRALGRPLVTTSATNTEGEPLTDAKDIKADLGHGLDLILDGGVTLNEPSTVISLIGDSLEILRQGKGRLED

SEQ ID NO: 14633 - DNA, 627 bp, Cytophaga hutchinsonii ATCC 33406
  CDS (1)..(627): transl_table=11
atgtctgcgctattgttaaaaatccatccggataatccaccattaaataaaatattaactgccgtagaaattatccggaaaggcggcattgtgatctacccaacggatacggtttatgcaattggctgtgatatccataatcagaaagctgttgaacgtgtgtgccggttaaaaaatattcagccgggcaaaataaacctgtcgtttatctgtcaggatctaagccatatttctgaatatacaaaagcattacccacacaagtgtttaaagttatgaagcaggtgctgccaggaccatatacattcatattaaatgccaataataatgttcctaacatattaaatacaaaaaagaaaacaattggtatccgcgtacctgataatagaattgttcagctgttacttaaagaattgggaaatccgatcttgagtacgtctattaaaaatgaagatgaaattttagaatatacgaccgatccggaagagatatatgagcggtataaaaacgttgtagatgttattattgacggcggttttggcggtaatgaagcatcaacaattcttgactgtacaggaaatgaaattgaggtgatccgcgaagggaagggaagtatagaagagctgtaa

SEQ ID NO: 14634 - protein, 208 aa, Cytophaga hutchinsonii ATCC 33406
MSALLLKIHPDNPPLNKILTAVEIIRKGGIVIYPTDTVYAIGCDIHNQKAVERVCRLKNIQPGKINLSFICQDLSHISEYTKALPTQVFKVMKQVLPGPYTFILNANNNVPNILNTKKKTIGIRVPDNRIVQLLLKELGNPILSTSIKNEDEILEYTTDPEEIYERYKNVVDVIIDGGFGGNEASTILDCTGNEIEVIREGKGSIEEL

SEQ ID NO: 14635 - DNA, 624 bp, Haemophilus somnus 129PT
  CDS (1)..(624): transl_table=11
atgagtcaatttttttatgttcattcagaaaatccacaatctagactgattaatcaggcagtggagattttacgtcaaggcggcgtaattgtttatccgaccgattccggttatgcactaggttgtatgattggagataagcatgcaatggatcgtattgtgaaaattcgccaactgcccgaagggcataattttaccttagtttgtagcgacctgtctgagttatcaacttattcagtagtgaataattcggtatatcgtttgattaaaaataatacaccgggtcgttatacttttattctaagtgcaacaaaagaattaccccgtcgtttaatgacatcaaaacgtaaaaccatcggtattcgtgttccggataatcaaattgcgttagatctattaaaatccttaggcgaaccaattttatcctgctctttaatgttgcccggagaagaatatacaacacaatccgatccagaggaaattcgagatcgccttgagcaccaagtagatttaatcattcatggcggatatttaagtcagcaaccgacaacagtagtggatctgacagaagataacccggttattttacgagaaggaagcggtgatattcgcccttttatataa

SEQ ID NO: 14636 - protein, 207 aa, Haemophilus somnus 129PT
MSQFFYVHSENPQSRLINQAVEILRQGGVIVYPTDSGYALGCMIGDKHAMDRIVKIRQLPEGHNFTLVCSDLSELSTYSVVNNSVYRLIKNNTPGRYTFILSATKELPRRLMTSKRKTIGIRVPDNQIALDLLKSLGEPILSCSLMLPGEEYTTQSDPEEIRDRLEHQVDLIIHGGYLSQQPTTVVDLTEDNPVILREGSGDIRPFI

SEQ ID NO: 14637 - DNA, 657 bp, Trichodesmium erythraeum IMS101
  CDS (1)..(657): transl_table=11
atggcaactttttacgaacttcatcctgatactccccaaaatagacgtgtagaaaaaattatcaatgatcttaaagatggggcagtaatgctttatcccacagatactgtttacgcaataggttgtgacctctatgttaaatctgctgtagaaaaagttagacaaattaagcaattgtctaatgataagcctctgacattcctctgttcctctttgtccaacattgccaattatgctgtggtgaatgactcagcctaccggattattaaacgtctaattcctggcccttacacatttgtgctgcctgcaaccaagttagtcccacgtctggttatgagtccaaaacgtaaaacaaccggtattcgggttcctaataatcaagtttgcttgaccttattaaaggccttagacaatcctattatttccacatcagctaacattaccagtgatgcagaaggaatagctccaataaaggtagaagtagtcacgggtaaagcagagttgtttgattgtctagaaaatcttgtggatataattgtagatgatggttctgactcaatatatcaagtatcaactatccttgacttaactggccatcagccaaatctgattcgtcaaggtcttggagttgaggctgtaatatctctgattagttaa

SEQ ID NO: 14638 - protein, 218 aa, Trichodesmium erythraeum IMS101
MATFYELHPDTPQNRRVEKIINDLKDGAVMLYPTDTVYAIGCDLYVKSAVEKVRQIKQLSNDKPLTFLCSSLSNIANYAVVNDSAYRIIKRLIPGPYTFVLPATKLVPRLVMSPKRKTTGIRVPNNQVCLTLLKALDNPIISTSANITSDAEGIAPIKVEVVTGKAELFDCLENLVDIIVDDGSDSIYQVSTILDLTGHQPNLIRQGLGVEAVISLIS

SEQ ID NO: 14639 - DNA, 621 bp, Shewanella sp. MR-7
  CDS (1)..(621): transl_table=11
atgagtcagtttttttatgtacacgaagtaaatccacaggtacgcctgatcagtcaagccgtggctgtgcttaagtccggcggtgtgattgtatatccaaccgattcgggctatgccctcggttgtatgattggcgagaaagacgcgatgacgcgcattacccgcattcgtcaaatcgaacacgatcataatttctccttgatgtgccgtgacttatctgagctttcgacctacgccaaggtagataatcaggcctaccgcatcttaaaaagctgcacgcctggaccttacactttcatctttaaggcgagcaaggaagtaccccgtcgtctgcaaaacgacaaaaagaaaaccattggtatccgcgtgccagacaatgtgattgccttggcgctactcgaggcgttagatgcgccgctgatgtccaccagtttggtgatgcccaatagtgattttgcagagtcagatcccgagcacattcgtgatctgctagagcatcaagtggatgtgatcctgcacggtggctacttaggtgaaaaaccgaccacagtcatcgatatgtcggaagatggtttcgaagtgctgcgtgaaggcgcgggtgatgttaccccatttctctaa

SEQ ID NO: 14640 - protein, 206 aa, Shewanella sp. MR-7
MSQFFYVHEVNPQVRLISQAVAVLKSGGVIVYPTDSGYALGCMIGEKDAMTRITRIRQIEHDHNFSLMCRDLSELSTYAKVDNQAYRILKSCTPGPYTFIFKASKEVPRRLQNDKKKTIGIRVPDNVIALALLEALDAPLMSTSLVMPNSDFAESDPEHIRDLLEHQVDVILHGGYLGEKPTTVIDMSEDGFEVLREGAGDVTPFL

SEQ ID NO: 14641 - DNA, 624 bp, Alkalilimnicola ehrlichei MLHE-1
  CDS (1)..(624): transl_table=11
atgagccagtactttgagatccaccccgtcacccctcaggttcgcctggtgaaacggaccgtggagatcatccgcgcgggcggtgtcatcgcctaccccaccgactccagttacgcgttgggttgcggcatcggggagaagcaggccgtggaccgcatccgccagatccgccgtctgcgcgaggaccacaacttcaccctggcctgccgcgatctctccgatatcggcacctacgcccgggtggagaactacgcctaccgcctgctcaagtcgcacaccccgggcccctacaccttcatcctgaaggccacctccaaggtgccccgtctgctccagcacccgaagaaaaagaccatcggcatccgcgtgcccgaccaccccaccacccaggccatcctggaagagctgggcgagccgctgatgacggtcagcctcatcatgcccgatgacgacatgcctatcaccgacccggtggacattcgcgcggccctggagcaccaggtggatgccgtcatcgacggcggtcccggcgggttggagcccagcaccgtggtggatctctccggtgaggccccgcgggtcctgcgcgagggtgccggcgatccgtcggtcttcgagggctga

SEQ ID NO: 14642 - protein, 207 aa, Alkalilimnicola ehrlichei MLHE-1
MSQYFEIHPVTPQVRLVKRTVEIIRAGGVIAYPTDSSYALGCGIGEKQAVDRIRQIRRLREDHNFTLACRDLSDIGTYARVENYAYRLLKSHTPGPYTFILKATSKVPRLLQHPKKKTIGIRVPDHPTTQAILEELGEPLMTVSLIMPDDDMPITDPVDIRAALEHQVDAVIDGGPGGLEPSTVVDLSGEAPRVLREGAGDPSVFEG

SEQ ID NO: 14643 - DNA, 630 bp, Pseudomonas aeruginosa UCBPP-PA14
  CDS (1)..(630): transl_table=11
atgagccagttcttccagatccatccggaaaatccccagccacggctggtcaagcaggcggtggaaatcgtccgccagggtggggtgatcgtctatcccaccgactcgtcctatgccctgggctgccgcatcggcgaaaagaccgcggtggatcgcatccgccgcatccgccaactggacgacaagcacaacttcaccctggtctgccgcgacctttccgagctgggggtctatgccaaggtcgacaccggcctgttccgcctgctcaaggcgcacacccccggtccctacaccttcatcctcagcgccacccgcgaggtgccgcgcatgctcctgcaccccaagcgccgcaccatcggcctgcgcgtgccgaactgtccgatcgcccgggcgctgctggaggagctaggcgaaccgctgatgagcgtgagcctgatcatgcccggcagcggcgagccactgaacgatccctatgaaatgcgccaggtactggaacaccaggtcgacctgatcgtggacgggggctatggcggcggcgaggcctccaccgtgatcagcctgaccgacaccgatcccgaagtgatccgcgtgggttgcggcgatccggcgccgttcatgcagccggcctga

SEQ ID NO: 14644 - protein, 209 aa, Pseudomonas aeruginosa UCBPP-PA14
MSQFFQIHPENPQPRLVKQAVEIVRQGGVIVYPTDSSYALGCRIGEKTAVDRIRRIRQLDDKHNFTLVCRDLSELGVYAKVDTGLFRLLKAHTPGPYTFILSATREVPRMLLHPKRRTIGLRVPNCPIARALLEELGEPLMSVSLIMPGSGEPLNDPYEMRQVLEHQVDLIVDGGYGGGEASTVISLTDTDPEVIRVGCGDPAPFMQPA

SEQ ID NO: 14645 - DNA, 621 bp, Magnetococcus sp. MC-1
  CDS (1)..(621): transl_table=11
atgagccaatattttaagattcatccagaaaatccacaagcacgcttgctgcgccaggctgcgcaaattctgcaagagggtggcgttattgtctacccaaccgacaccacttacggattaggctgtgtgatgagcaaccgtaaaggggtggagcgggtggtgcgtatcaagcagctctccgatacccaccaattgacgctgctgtgtgcggatctctcggatattgcgaactatgcccgtgtggataacagctgttatcgtctgctcaaacggtttttgcccggcccttatacctttgtcttggaggcctcccgcgaggtgccgaaaaaaatcctgccacggcgtaaaaccattggcctacgggtgcccaatcatcaaatttgccatgcgctgttggaactggtgggggagccgctgctctcgacttcggtacgtttgccagggcatgaggagattttcaccgatccttctctcataagggaccaacttgaacaccaggtcgacttgatcattgatgggggtattttacccgaacacccctcgaccattattgatatgaccagcggggaacctgagttgctacgcgaaggggcgggggattcggcggccatttttaagtaa

SEQ ID NO: 14646 - protein, 206 aa, Magnetococcus sp. MC-1
MSQYFKIHPENPQARLLRQAAQILQEGGVIVYPTDTTYGLGCVMSNRKGVERVVRIKQLSDTHQLTLLCADLSDIANYARVDNSCYRLLKRFLPGPYTFVLEASREVPKKILPRRKTIGLRVPNHQICHALLELVGEPLLSTSVRLPGHEEIFTDPSLIRDQLEHQVDLIIDGGILPEHPSTIIDMTSGEPELLREGAGDSAAIFK

SEQ ID NO: 14647 - DNA, 621 bp, Shewanella sp. ANA-3
  CDS (1)..(621): transl_table=11
atgagtcagtttttttatgtacacgaagtaaatccacaggtacgcctgatcagtcaagcagtggctgtgcttaagtccggcggtgtgattgtatatccaaccgattcgggctatgccctcggttgtatgattggcgagaaagacgcgatgacgcgcattacccgcattcgtcaaatcgagcatgaccataatttctcgttaatgtgccgcgacttatccgagttagcgacctatgccaaggtggataatcaggcctaccgcatcttaaaaagctgcacgcctggaccttacactttcatctttaaggcgagcaaggaagtaccccgtcgtctgcaaaatgacaagaagaaaaccataggtatccgcgtgcctgataatattattgccttagctctgctcgaagcgttagatgcgccgctgatgtcgaccagtttggtgatgccaaatagtgattttgctgaatctgatcctgagcacattcgcgatctgttagaacatcaagtggatgtgattattcacggcggttatttaggtgaaaaaccgaccacggtcattgatatgtcggaagatggtttcgaagtgctgcgtgaaggcgcgggtgatgtgaccccctttctctaa

SEQ ID NO: 14648 - protein, 206 aa, Shewanella sp. ANA-3
MSQFFYVHEVNPQVRLISQAVAVLKSGGVIVYPTDSGYALGCMIGEKDAMTRITRIRQIEHDHNFSLMCRDLSELATYAKVDNQAYRILKSCTPGPYTFIFKASKEVPRRLQNDKKKTIGIRVPDNIIALALLEALDAPLMSTSLVMPNSDFAESDPEHIRDLLEHQVDVIIHGGYLGEKPTTVIDMSEDGFEVLREGAGDVTPFL

SEQ ID NO: 14649 - DNA, 627 bp, Nocardioides sp. JS614
  CDS (1)..(627): transl_table=11
atggcccgctacgtcgacgtacaccccgagaacccccagtcccgcctgctcgaccagatcgccgacgcgctgcgcgaggaccagctgatcgcctacccgaccgactcgggctacgcgctcggctgccggctcggcaaccgcgagggtcgggaccggatcctgcggatccgccggctcgacgagaagcaccacttcacgctgatgtgcaaggacttcgcccagctcgggcacttcgtgaagttggacaactccgcgttccgctcgatcaaggccgcgaccccggggccgtacacgttcatcctgccggcgacccaggaggtcccccgccggctgatgcaccccaagaagcgcaccgtgggcgtccggatcccggcgcacgtcttcgaccaggccctcctggggaccctcggtgaggcgctgttgaccagcaccctgatcctgccgggggagaccgagccgcgcagcctcggctgggagatcaaggaggagctcgaccaccaggtcgacgtggtggtcgaggcgggcgagacgctggccgagccgaccaccgtcatcgactggtcggagggctaccccgaggtgctgcgggtcggcgccggcgacccggcccgcttcgaggccgcctga

SEQ ID NO: 14650 - protein, 208 aa, Nocardioides sp. JS614
MARYVDVHPENPQSRLLDQIADALREDQLIAYPTDSGYALGCRLGNREGRDRILRIRRLDEKHHFTLMCKDFAQLGHFVKLDNSAFRSIKAATPGPYTFILPATQEVPRRLMHPKKRTVGVRIPAHVFDQALLGTLGEALLTSTLILPGETEPRSLGWEIKEELDHQVDVVVEAGETLAEPTTVIDWSEGYPEVLRVGAGDPARFEAA

SEQ ID NO: 14651 - DNA, 633 bp, Azoarcus sp. BH72
  CDS (1)..(633): transl_table=11
atggcccagttcttttccctgcaccccgaccaaccacaaccgcgcctcatccgtcaggccgcggagatcatccgcggtggcggccttgtcgcctttcccaccgactctgcctacgcactgggcggccacaccggcgatgcgccgctgctggagcggatacgccgcatccgcggggtggacgagcgtcaccaattcacgctgctgtgccgcgacctgtcggagattgcaacctacgcgcgggtcgacaacagccagtaccgtttgctgaaggcggtgacgcccggtgcgtacactttcattctcgaaggcacccgcgagttgccgcggcgtgtgctgcatccgaaacgcaagacgatcggcctgcggattcccgaacacgcggtggtttccgcgctgctggccgagctcggcgagccgctcctgtcttcgacgctgctgctgcccgacgaagatctgcccctgaccgacccggaggagattcgcgaccggctggaaaagcaggtcgatctggtgatcgaagccggcttctgcggtccggaggcgaccaccgtggtcgatctcacctccggcgtgccggtactggtgcgcgctggccgcggcgagcttgcaccgcttggcctggaggcgccctga

SEQ ID NO: 14652 - protein, 210 aa, Azoarcus sp. BH72
MAQFFSLHPDQPQPRLIRQAAEIIRGGGLVAFPTDSAYALGGHTGDAPLLERIRRIRGVDERHQFTLLCRDLSEIATYARVDNSQYRLLKAVTPGAYTFILEGTRELPRRVLHPKRKTIGLRIPEHAVVSALLAELGEPLLSSTLLLPDEDLPLTDPEEIRDRLEKQVDLVIEAGFCGPEATTVVDLTSGVPVLVRAGRGELAPLGLEAP

SEQ ID NO: 14653 - DNA, 765 bp, Neisseria meningitidis FAM18
  CDS (1)..(765): transl_table=11
ttgcctgcgacactgccgaacttgccggcatcttgtagccaaaaaagggacgagtccgcacaatgccgtctgaaattttcagacggcattttgtttggattttgggcgtacaatacggaaaacatgacgataaggacacaaaccatggcacagtttttcgctattcatcccgacaatccccaagaacgcctcatcaagcaggcggttgaaatcgtcaatcaaggcggcgtggtggtttatccgaccgattcgtgttacgccttgggttgcaaactcggcgataaggcggcgatggaacgcatactctccatccgcaaaatcgatttgaaacaccacctgaccctgatgtgcgccgatttgagcgagttgggcacgtacgccaaaattgacaacgtacagtttcgtcagcttaaagccgccacgcccgggccttatacctttatcttgcaggcgacgaaggaagtgccggcgcgcacgctgcacccgaaacgcaaaaccatcgggctgcgtattcccgataatgccattgcacaagccctgctgggggaattgggcgagccgcttttaagctgcaccctgatgctgcccgaagacggcgaaccattgaccgatccttatgaaatccgcgagcgtttggaacacgccgtcgatttggtgattgacggcggctggtgcggaaccgagccgaccaccgtcgtcgatatgaccgacggcacggaactggtgcgccggggttgtggcgatacggcggtgttcggtttgtag

SEQ ID NO: 14654 - protein, 254 aa, Neisseria meningitidis FAM18
MPATLPNLPASCSQKRDESAQCRLKFSDGILFGFWAYNTENMTIRTQTMAQFFAIHPDNPQERLIKQAVEIVNQGGVVVYPTDSCYALGCKLGDKAAMERILSIRKIDLKHHLTLMCADLSELGTYAKIDNVQFRQLKAATPGPYTFILQATKEVPARTLHPKRKTIGLRIPDNAIAQALLGELGEPLLSCTLMLPEDGEPLTDPYEIRERLEHAVDLVIDGGWCGTEPTTVVDMTDGTELVRRGCGDTAVFGL

SEQ ID NO: 14655 - DNA, 636 bp, Acidovorax sp. JS42
  CDS (1)..(636): transl_table=11
atggcccaatatttcgagatctacgccgacaacccgcagccgcgcctgctcaagcaggccgccacgctgctgtcgagcggcggcatcctggccgtgcccaccgactccagctacgcgctggtctgccgcctggacgacaaggacgccgtggaccagattcgtcgtattcggcagatcaacgacaagcaccacctcaccctgctgtgccgcgacctgtcggaactggccaattacgcgcatgtggacaaccgccaatatcgcctgctgaagttggccacgccggggccttacaccttcatcctggacgccaccaaggaagtgccgcgccgcgtgagccatccgcagcgcaagaccatcggtctgcgcgtgcccgaccgcaagggcctgcagatgctgctggagctgcacggcgcgccgctgctggccaccacactgatcccggcgggcgaaagcgagccgctgaacgacccgcaggagatccgcgagcgctttgaaaagcagctcgatggcatcctcgatgcgggcggctgcccgctggagcccactacggtactggacctcacgcccatgaataccggcggcgaccccatcgtggtgcgcgaaggtggcggcagcctggccaagctggggctttaa

SEQ ID NO: 14656 - protein, 211 aa, Acidovorax sp. JS42
MAQYFEIYADNPQPRLLKQAATLLSSGGILAVPTDSSYALVCRLDDKDAVDQIRRIRQINDKHHLTLLCRDLSELANYAHVDNRQYRLLKLATPGPYTFILDATKEVPRRVSHPQRKTIGLRVPDRKGLQMLLELHGAPLLATTLIPAGESEPLNDPQEIRERFEKQLDGILDAGGCPLEPTTVLDLTPMNTGGDPIVVREGGGSLAKLGL

SEQ ID NO: 14657 - DNA, 660 bp, Nostoc punctiforme PCC 73102
  CDS (1)..(660): transl_table=11
atggcaaaaattttctcagtccatccggataatcctcaaattcgtcgaatagaggaaataaagtcggcgctttctagtggcgcagtcatgctttaccctactgatacagtttatgcgatcggttgtgatttgaatgctaagtcggcggtagaacgagtgcggcaaattaaacagctagcaaatgataaaccactgacatttttatgtccctcgctttcaaatgtggcaacttatgccttcgtaagtgacacagcctatcggattatgaaacgcctgattccagggccatacacgtttttgctcccagcaactaaattagtaccgcgattggtgcaaagccccaagcggaaaagtactggaattagagtaccaaaccatactgtgtgtttggagttgctggcagctttgggcaatccgattatttcaacttcagcacatctgccagcagatgaagcagataatggcatgattcggatagatccagaaactgttcagtcgcgggtagagctatttgaccgtttggacaagttggtagacataattgtagacactggcgaagaacctacttatgaggtctctaccatcttagatatgaccggagacgaagcagcaattatacggaggggtttaggttgggaagcagcagcagcatgggtataa

SEQ ID NO: 14658 - protein, 219 aa, Nostoc punctiforme PCC 73102
MAKIFSVHPDNPQIRRIEEIKSALSSGAVMLYPTDTVYAIGCDLNAKSAVERVRQIKQLANDKPLTFLCPSLSNVATYAFVSDTAYRIMKRLIPGPYTFLLPATKLVPRLVQSPKRKSTGIRVPNHTVCLELLAALGNPIISTSAHLPADEADNGMIRIDPETVQSRVELFDRLDKLVDIIVDTGEEPTYEVSTILDMTGDEAAIIRRGLGWEAAAAWV

SEQ ID NO: 14659 - DNA, 654 bp, Crocosphaera watsonii WH 8501
  CDS (1)..(654): transl_table=11
atggctattctatacgatttacaccctaaaaaccctcaaaatcatcgcattgacgaaatatgttctgctctaagacaaggggcgattatgctataccctacagatacagtgtatgcgatcgggtgcgatcttaatagtaaatcggccgtgcaacgggtacgacaattaaagcaattatctaatgataaacccttgacttttttgtgttcttctctatccaatattgctaaatatgcaggggtagaggatgaagcttatcgtgttatgaaaaggttaattcctgggccttatacctttttattaccagctaccaaagctgtgccaaaattagtcatgagtcctaagcgaaaaagtacaggtattcgagtaccagatcaccctatttgtcaagctattttacaaggtttagaaaatcccattgtttctacttctgctcatttaccggatgaagatggggagtttcctactcttggcttagaaaaagtaaaattatttgacattttagaaaatcaagttgatattattattgataatagtttagaacctggttttgaggtgtctactattttagacatgacttccgatcccccttccattattcgtcaggggttgggatgggaagaattacaaaattgggtgaagcttcaagtttaa

SEQ ID NO: 14660 - protein, 217 aa, Crocosphaera watsonii WH 8501
MAILYDLHPKNPQNHRIDEICSALRQGAIMLYPTDTVYAIGCDLNSKSAVQRVRQLKQLSNDKPLTFLCSSLSNIAKYAGVEDEAYRVMKRLIPGPYTFLLPATKAVPKLVMSPKRKSTGIRVPDHPICQAILQGLENPIVSTSAHLPDEDGEFPTLGLEKVKLFDILENQVDIIIDNSLEPGFEVSTILDMTSDPPSIIRQGLGWEELQNWVKLQV

SEQ ID NO: 14661 - DNA, 621 bp, Croceibacter atlanticus HTCC2559
  CDS (1)..(621): transl_table=11
atggcagaactaatacgtatatacgaagacaacccaaatcctaaacaaataaagcaagtagtaaatgcattgcgtgatggagctttggttatttacccaacagacacagtttatgggcttggttgtgatatctctaatgtaagcgccttagagcgtattgctaagctaaaaaatgtaaaattagagaaggcaaatttttcttttatctgtgaagatttaagtaacctatcagactatgtaaagcaaatagatacgcgtacatttaaaatattgaagcgttgtttgccaggaccttatacatttattcttccaggcaataataacttacctaacgtctttaagaaaaagaagactgttggaataagagtaccagataacagtatttgtaatgcattagtaagtgggctaggtaatccaattatttcaacatctattagagatgaagatgacgttatagagtatactacagacccaagtcttattttagaaaaatgggacaaacacgtagatattgttatagatggaggctatggagataatatagcctcaacagttatagatcttacaggtgatgaagccgaagtaatacgagaaggtaaaggaagtttagaaatatattaa

SEQ ID NO: 14662 - protein, 206 aa, Croceibacter atlanticus HTCC2559
MAELIRIYEDNPNPKQIKQVVNALRDGALVIYPTDTVYGLGCDISNVSALERIAKLKNVKLEKANFSFICEDLSNLSDYVKQIDTRTFKILKRCLPGPYTFILPGNNNLPNVFKKKKTVGIRVPDNSICNALVSGLGNPIISTSIRDEDDVIEYTTDPSLILEKWDKHVDIVIDGGYGDNIASTVIDLTGDEAEVIREGKGSLEIY

SEQ ID NO: 14663 - DNA, 621 bp, Pseudoalteromonas tunicata D2
  CDS (1)..(621): transl_table=11
atgagtcaattttttcaaattcatgtcgacaatcctcaaacgcgacttattcgtcaagcgattgaagtgattcaaaaaggtggcgtgattgtctatccaacagattcgggttatgcccttggatgtagtattggaaataaaaccgctatggagcgtatccagcgtattcgttctttagaaaaacaccataacttaaccttagtctgctgcgatttatctgaacttgcaacctatgcacgagttgataaccaaatgtttcgtttggtgaaaaacaatacaccaggcgcttatacctttatttttaaagggacaaaagaagtaccaaaacgtttactgaatgataagaaaaaaactattgggatccgtgttcctaaccacaaaatcactcaggcattattggcagaacttggcgagccaatcatgtcttgttcattgattttaccaggacaagaacatacagaatcagatcctgaagtaattcgatcattacttgaaaaacaggttgatttaattattgatggtggctacttgattgagcaagcaaccacagtaatcgatttatcagacgacagtgttgagatattacgtgtcggttgcggtgatgtcagtccgttcgagtaa

SEQ ID NO: 14664 - protein, 206 aa, Pseudoalteromonas tunicata D2
MSQFFQIHVDNPQTRLIRQAIEVIQKGGVIVYPTDSGYALGCSIGNKTAMERIQRIRSLEKHHNLTLVCCDLSELATYARVDNQMFRLVKNNTPGAYTFIFKGTKEVPKRLLNDKKKTIGIRVPNHKITQALLAELGEPIMSCSLILPGQEHTESDPEVIRSLLEKQVDLIIDGGYLIEQATTVIDLSDDSVEILRVGCGDVSPFE

SEQ ID NO: 14665 - DNA, 621 bp, Photobacterium sp. SKA34
  CDS (1)..(621): transl_table=11
atgagtcaatttttttatgttcacccagaaacaccccaaacgcgtttgattaaacaagcggtagaaattattaaaaatggcggtgtcgtggtttatccaacggattctggttatgcccttggttgtcagttagaaaataaacaagcactagagcgtatttgtcagatccgtcgcctaaacgaaaagcacaactttactttgttatgccgtgatttatctgagctatctttatacacccgtgttgataatatcgctttccgtcttttacgtaataacaccccaggtgcatacacctttatatttaaaggaacaaaagaagtacctcgccgtttaatgaatgcaaagcgtaaaacgattggtattcgtgtacctgataatgcgattgcactggcattacttgaagcactaggtgagccactaatgtcaaccagccttatcttaccgggtaatgaaacaacagaagcggatcccgatgacattcgcgataagttagaacatgctgttgatttgattatgcatggtggttacttaggtgagcagccaacaaccgtgattgatttcagtgacggtgaaattaatattgttcgagttggtgcaggtgatgtgacaccgtttgaatga

SEQ ID NO: 14666 - protein, 206 aa, Photobacterium sp. SKA34
MSQFFYVHPETPQTRLIKQAVEIIKNGGVVVYPTDSGYALGCQLENKQALERICQIRRLNEKHNFTLLCRDLSELSLYTRVDNIAFRLLRNNTPGAYTFIFKGTKEVPRRLMNAKRKTIGIRVPDNAIALALLEALGEPLMSTSLILPGNETTEADPDDIRDKLEHAVDLIMHGGYLGEQPTTVIDFSDGEINIVRVGAGDVTPFE

SEQ ID NO: 14667 - DNA, 618 bp, Neptuniibacter caesariensis
  CDS (1)..(618): transl_table=11
atgagtcagtttttccagatccatcctgaaaacccacagcagcgtttgattaatcaagcggtagaaattattaatcgtggtggggttgttatttatcctacggattgcgcctatgcgctaggctgccatctgggagataagtcggcgcttgaaaagattaagcgaattagacagttggatgataagcacaactttactctggtgtgtcgtgatctgagtgaaataagtacttatgcgaaggttgataatagctgttatcgtcttttgaagtcacataccccaggcgcttatacttttattctaaaggctacctccgaagttccaagaagattgcttcatcccaaaaggagaacgatcggaatcaggatccctgataatccgattgcgctggcattaacagaagctttaggtgagccaataatgagtacttctctaataatgccaggggaagagatgcctttaatggatccatatgaaatgcgcgagctacttcagcatcaagtcgatcttgtaattgatggtggttattgcggaatggaagctacaagtgtaattaatttagttgaagaaacgcctgaaattattcgtgaaggcgcaggtgatgtatctgatttttaa

SEQ ID NO: 14668 - protein, 205 aa, Neptuniibacter caesariensis
MSQFFQIHPENPQQRLINQAVEIINRGGVVIYPTDCAYALGCHLGDKSALEKIKRIRQLDDKHNFTLVCRDLSEISTYAKVDNSCYRLLKSHTPGAYTFILKATSEVPRRLLHPKRRTIGIRIPDNPIALALTEALGEPIMSTSLIMPGEEMPLMDPYEMRELLQHQVDLVIDGGYCGMEATSVINLVEETPEIIREGAGDVSDF

SEQ ID NO: 14669 - DNA, 618 bp, Flavobacteria bacterium BBFL7
  CDS (1)..(618): transl_table=11
atggcacaattagtacgtatatatgaggacaatcctagtcctaaagaattacagcgtatcgcaaaagctatgagagatggcgctcttgtgatatatcctacagataccgtttatggtctaggttgtgatatcaatcataaaggtgctcttgaaaaagttgccaaaatacgtggcgtaaagctggaaaaagctaatttttcttttatatgtgaaagcttaagtaatttaagtgaatatgtaagtcaaatagatacagcaacttttaaattattgaaacgcaatctacctggtccttacacttttatattgccaggtaacaataatttaccatctgtttttaagaaaaagaaaacagtaggtattcgtgtaccagataattcaatcgcaataggtcttgttcaggcgctaggcaatcctattatttccacttctattaaggatgaggatgaggtaatagaatataccactgaccctagtcttatagtagaaaaatgggataatctagtagattatgttattgatggtggttatggagataatattgcttctacagttatagatttaaccggtgatgaacctgtactggtaagagaaggaaaaggtagtgtagagttgtaa

SEQ ID NO: 14670 - protein, 205 aa, Flavobacteria bacterium BBFL7
MAQLVRIYEDNPSPKELQRIAKAMRDGALVIYPTDTVYGLGCDINHKGALEKVAKIRGVKLEKANFSFICESLSNLSEYVSQIDTATFKLLKRNLPGPYTFILPGNNNLPSVFKKKKTVGIRVPDNSIAIGLVQALGNPIISTSIKDEDEVIEYTTDPSLIVEKWDNLVDYVIDGGYGDNIASTVIDLTGDEPVLVREGKGSVEL

SEQ ID NO: 14671 - DNA, 621 bp, delta proteobacterium MLMS-1
  CDS (1)..(621): transl_table=11
atgttactggaaatcaaccccgacaacccccagccccgtttaatcaaacgggtggtggaagccctgcgccagggagcggtgatttgctatcccaccgacacggtctatggtattggctgtgatatcttcaaccagaaggcggttaagcggatctaccagctcaagtgccggcccctgggccagcccttcagctttatctgcgccgatctcaaggagatcagcaactacgcccatgtctccaacaccggctatcgggtgatgcgcaaaagcctgcccggcccctatacctttgttttacccgccaccaagctggtgcctaaaatcatgatgagcaagcagaagacggtggggatccgggtgccggacaaccggatctgcctggaactggtggccgggctgggcaacccgatcctgaccacctccgccgctcccgacgaccccgattcccgccagttactggcttttgaggtcgacgagcgctacggccacctggtggattacaccatcgacagcgggccgctgaccgtggctcaaccgtcgacggtggtctccatggtcgacgatgaactcacggtgctgcggcccggtaagggaaggctggaagacctgggggtgggctga

SEQ ID NO: 14672 - protein, 206 aa, delta proteobacterium MLMS-1
MLLEINPDNPQPRLIKRVVEALRQGAVICYPTDTVYGIGCDIFNQKAVKRIYQLKCRPLGQPFSFICADLKEISNYAHVSNTGYRVMRKSLPGPYTFVLPATKLVPKIMMSKQKTVGIRVPDNRICLELVAGLGNPILTTSAAPDDPDSRQLLAFEVDERYGHLVDYTIDSGPLTVAQPSTVVSMVDDELTVLRPGKGRLEDLGVG

SEQ ID NO: 14673 - DNA, 615 bp, delta proteobacterium MLMS-1
  CDS (1)..(615): transl_table=11
atggaaatcaaccccgacaacccccagccccgtttaatcaaacgggtggtggaagccctgcgccagggagcggtgatttgctatcccaccgacacggtctatggtattggctgtgatatcttcaaccagaaggcggttaagcggatctaccagctcaagtgccggcccctgggccagcccttcagctttatctgcgccgatctcaaggagatcagcaactacgcccatgtctccaacaccggctatcgggtgatgcgcaaaagcctgcccggcccctataccttcgttttacccgccaccaagctggtgcctaaaatcatgatgagcaagcagaagacggtggggatccgggtgccggacaaccggatctgcctggaactggtggccgggctgggcaacccgatcctgaccacctccgccgctcccgacgaccccgattcccgccagttactggcttttgaggtcgacgagcgctacggccacctggtggattacaccatcgacagcgggccgctgaccgtggctcaaccgtcgacggtggtctccatggtcgacgatgaactcacggtgctgcggcccggtaagggaaggctggaagacctgggggtgggctga

SEQ ID NO: 14674 - protein, 204 aa, delta proteobacterium MLMS-1
MEINPDNPQPRLIKRVVEALRQGAVICYPTDTVYGIGCDIFNQKAVKRIYQLKCRPLGQPFSFICADLKEISNYAHVSNTGYRVMRKSLPGPYTFVLPATKLVPKIMMSKQKTVGIRVPDNRICLELVAGLGNPILTTSAAPDDPDSRQLLAFEVDERYGHLVDYTIDSGPLTVAQPSTVVSMVDDELTVLRPGKGRLEDLGVG

SEQ ID NO: 14675 - DNA, 624 bp, Oceanobacter sp. RED65
  CDS (1)..(624): transl_table=11
atgagtcagttttttcagattcaccccgaaacgcctcaaccgcgtctggtaaagcaggcggcggatatcttaaagcaaggtggtcttgcggttattccgaccgattgtgcttatgccttagcatgccacattcaagacaagcaggcattggagcgcgtgaagcgcattcgtaaattggatgacaagcacaacttcaccctaatgtgccgagacctcactgaaatcagcacctatgccaaagtggacaatactgcgtaccgactactaaaaaaccatacccccggggcttttacttttattttggatggcactcgcgaggtgccacgtcggttgatgcacccgaagcgtaagcaaatcggcattcgagtcccagacaacgctattgcttgtgccattatggaagaattaggcgaaccactaatgaccacctctctgattatgccgggggacacaatgcctttgtccgacccttatgatattcgccaaatgcttgagcatgcggtggatttagtggttgatggcggatactgtggctttgaggccactactgtcgttgatatgacaggggatgaatacagcattacccgtcagggggttggccagctgcctgagcttgaggtctag

SEQ ID NO: 14676 - protein, 207 aa, Oceanobacter sp. RED65
MSQFFQIHPETPQPRLVKQAADILKQGGLAVIPTDCAYALACHIQDKQALERVKRIRKLDDKHNFTLMCRDLTEISTYAKVDNTAYRLLKNHTPGAFTFILDGTREVPRRLMHPKRKQIGIRVPDNAIACAIMEELGEPLMTTSLIMPGDTMPLSDPYDIRQMLEHAVDLVVDGGYCGFEATTVVDMTGDEYSITRQGVGQLPELEV

SEQ ID NO: 14677 - DNA, 621 bp, Vibrio sp. Ex25
  CDS (1)..(621): transl_table=11
atgagccagtttttttacgttcacccagaaaacccacaggctcgcttgattaatcaagcagtagcaatcattcgtaacggcggcgttgtggtgtaccctaccgattcagggtacgcacttggctgtcagttggagaacaaacaggcactggaacgaatctgtcagatccgtcgtctcgatgataagcataactttactttattgtgtcgtgatttgtcggagctttctctatatgcgcgagtagataactctgcattccgactactgaaaaacaacacaccaggtccttacaccttcatcttcaaaggcacgaaagaagtgccgcgtcgtttgatgaacgcgaaacgtaagaccatcggtatccgtgttccagacaatcaaattgccttggacttgttggaagcattaggtgaaccgatgatgtctacgtcgttgattctacctggcagtgacgtaacagagtctgatccggaagatattcgcgataaactagaacatgcggttgatgtgattcttaatggcggttacttaggtgaacaacctacgaccgtcattgactttagcgaaggtgaacctgttgtggtgcgtttgggatcaggtgacccggcaccattcgaataa

SEQ ID NO: 14678 - protein, 206 aa, Vibrio sp. Ex25
MSQFFYVHPENPQARLINQAVAIIRNGGVVVYPTDSGYALGCQLENKQALERICQIRRLDDKHNFTLLCRDLSELSLYARVDNSAFRLLKNNTPGPYTFIFKGTKEVPRRLMNAKRKTIGIRVPDNQIALDLLEALGEPMMSTSLILPGSDVTESDPEDIRDKLEHAVDVILNGGYLGEQPTTVIDFSEGEPVVVRLGSGDPAPFE

SEQ ID NO: 14679 - DNA, 621 bp, Alteromonadales bacterium TW-7
  CDS (1)..(621): transl_table=11
atgagtcaattatttcatattcatccagataacccacaagcaagattaataactcaagctgttgatataataaaacaaggtggggttgttgtttaccctaccgactctggctatgcgattggctgtaatattggcaataagcaagccaaagagcgtatagagcgtattcgtggcattgataaaaacgacaattttacacttgtatgtcgtgatttatcagagttatctacttacgcacgcgttgataatcaattattccgactgattaaaaataatacgccgggaccttatacctttatttttaaaggtacaaaggaagtacctaagcgtttattaaacgataagaaaaaaacgattggcatacgtgttattgagcacccgattgcatgtgcgcttttagctgagttgggcgagccactcatgtcgtgttcgctaatcttacccggacaagaatttacagagtcggacccagacgagattttagataggcttgataagcacgtagatctaattattcatggtggatacttaccagagcaggcaacaaccgttattgatttgtccgaggacgatgtaaaaatactgcgtgttggctgtggtgatgtgagcccgtttgagtaa

SEQ ID NO: 14680 - protein, 206 aa, Alteromonadales bacterium TW-7
MSQLFHIHPDNPQARLITQAVDIIKQGGVVVYPTDSGYAIGCNIGNKQAKERIERIRGIDKNDNFTLVCRDLSELSTYARVDNQLFRLIKNNTPGPYTFIFKGTKEVPKRLLNDKKKTIGIRVIEHPIACALLAELGEPLMSCSLILPGQEFTESDPDEILDRLDKHVDLIIHGGYLPEQATTVIDLSEDDVKILRVGCGDVSPFE

SEQ ID NO: 14681 - DNA, 624 bp, marine gamma proteobacterium HTCC2143
  CDS (1)..(624): transl_table=11
atgagccagttttttcagattcatcccgataacccccagagccgattaatcaaccaagcggtcgatattctgaaaggcgggggtgttattgtctatccgaccgattccggttatgcgatcggctgccaactgggtaataaaaaggcccttgatacaattaggcgggttcgtaagctggatagcagtcataatttcacgctggtttgtcgtgatctctccgaattagggagttacgccaaagtcgacaacaccgcttatcgtcttcttaaaaatcacaccccgggcccttatacttttatcctaaaagcgacgagtgaagtgcctaagcggcttatgcatccgaagcggcgaaccattgggctgcgggttccggagaacaacattgcattgcaattgttggccggtctcaacgagccgatgatgagtgttacgatgatattgccgggggacgatttacccatgacggacccctacgatatacgccagacccttgagcatgagcttgatctggttattgatggcggatattgcggcatggagccaacgtcagtaattgatttggtcgatgacatgccggttattatccgcagaggtcagggtgatgttagtgtatttgacctataa

SEQ ID NO: 14682 - protein, 207 aa, marine gamma proteobacterium HTCC2143
MSQFFQIHPDNPQSRLINQAVDILKGGGVIVYPTDSGYAIGCQLGNKKALDTIRRVRKLDSSHNFTLVCRDLSELGSYAKVDNTAYRLLKNHTPGPYTFILKATSEVPKRLMHPKRRTIGLRVPENNIALQLLAGLNEPMMSVTMILPGDDLPMTDPYDIRQTLEHELDLVIDGGYCGMEPTSVIDLVDDMPVIIRRGQGDVSVFDL

SEQ ID NO: 14683 - DNA, 627 bp, marine gamma proteobacterium HTCC2080
  CDS (1)..(627): transl_table=11
ttgagccaattttttgcaattcacccagagacgccccaacttcgcttggttcgccaggcggtggaaattttgcgatcgggcggggttatcgcctatccgacagattctgcctacgcgttgggatgtcgtttgggagataagcgcgcgctagagtgcattcggcggattcgaaagcttgatgataatcacaatttcacgttggtatgcccggacctatccgtgttgggggcttatgccaaggttgataatagtgcttatcgactgattaagaatgccacgccggggccctacacgtttattctcgaagcaacgggagaggtgccgcggcgcctgctgcatcctcgcaggaaaaccgtgggagttcgcgttccagacaatgccatcacacaggcgctgttggctgaatttgcagaacccatcatgagtgtgactttgcaactgcccggggatgattatcccctgactgacccctatgacattcggacaacactagagcatgacgtggcgctggtcatagatggtggcttttgcggtcttgagcccaccaccgtgatcgatttgtcggctgatagctacgaggtattgcgcgaaggcttgggtgacattagtcgactcgctttgggctga

SEQ ID NO: 14684 - protein, 208 aa, marine gamma proteobacterium HTCC2080
MSQFFAIHPETPQLRLVRQAVEILRSGGVIAYPTDSAYALGCRLGDKRALECIRRIRKLDDNHNFTLVCPDLSVLGAYAKVDNSAYRLIKNATPGPYTFILEATGEVPRRLLHPRRKTVGVRVPDNAITQALLAEFAEPIMSVTLQLPGDDYPLTDPYDIRTTLEHDVALVIDGGFCGLEPTTVIDLSADSYEVLREGLGDISRLALG

SEQ ID NO: 14685 - DNA, 621 bp, Marinobacter sp. ELB17
  CDS (1)..(621): transl_table=11
atgagtcagttttttcagattcatccggataatccgcaaaagcgccttattaatcaggcggtggatattcttcgcaaaggcggcgttattgcgtacccgaccgactcgggctatgcgttaggctgccatttgggtgacaaatctgcttctgatcgaataaaacgcattcgcaagctggacgacaagcacaacttcaccttggtttgcagggatttgtcagacattggcacttacgccaaggtcgacaacaccacctaccgaatgctgaaaacctacacgcccggtgcttacaccttcattctggacgccaccagtgaggtgccacggcgtttgttgcaccccaagcgccgcactattggcgtccgtgttcctgacaacgcggttgtgcatgcacttttgggggagttcggcgaacccatcatgagcagcacgctgatactgcccggcgaaaccgagccaatgaccgatccggaagacattcgcgatgcgctcgaacacgagttggatttgattattgacggtggtttctgcggtatggaagccaccacagtggttaattttaccagtggcagtccggtagtgacacgggtaggcaagggcgacccgtcgccgtttgagtaa

SEQ ID NO: 14686 - protein, 206 aa, Marinobacter sp. ELB17
MSQFFQIHPDNPQKRLINQAVDILRKGGVIAYPTDSGYALGCHLGDKSASDRIKRIRKLDDKHNFTLVCRDLSDIGTYAKVDNTTYRMLKTYTPGAYTFILDATSEVPRRLLHPKRRTIGVRVPDNAVVHALLGEFGEPIMSSTLILPGETEPMTDPEDIRDALEHELDLIIDGGFCGMEATTVVNFTSGSPVVTRVGKGDPSPFE

SEQ ID NO: 14687 - DNA, 621 bp, Moritella sp. PE36
  CDS (1)..(621): transl_table=11
atgagtcaatttttttacgtgcatcctgataatccgcaagcgcgtttaatcagtcaggccgttgctattttacgtgatggtggtgtgatcatttatcccaccgattctggctatgcgctaggttgtcatcttggtgacaaaaacgcattagagcgtatttgtaagatccgtaagttagataaagatcataattttaccttgttgtgccgtgatctatcagaattgtcgttatacgcacgtgttgagaaccaggcttaccgcgcgcttaaaaataataccccaggtccatttacgtttatttttaaaggcacgaaagaagtgccacgacgtttaatgaatccgaagcgtaaaaccatcggtattcgtgtgcctgacaatacgattgcattagcaatactcgaagcgttaggtgaacctatgatgtcgacgtcgttaatcttaccgggtaatgaaggcgctgaatttgatccggaagcgatccgtgaccaacttgaaaaccaagtcgagctgattatcaatggcggctacttaggtgagcaagtaacaacggttgtggattattctgaaggtgatgctgttattgttcgtcaaggtgccggtgatgcatcctcgtttgcttaa

SEQ ID NO: 14688 - protein, 206 aa, Moritella sp. PE36
MSQFFYVHPDNPQARLISQAVAILRDGGVIIYPTDSGYALGCHLGDKNALERICKIRKLDKDHNFTLLCRDLSELSLYARVENQAYRALKNNTPGPFTFIFKGTKEVPRRLMNPKRKTIGIRVPDNTIALAILEALGEPMMSTSLILPGNEGAEFDPEAIRDQLENQVELIINGGYLGEQVTTVVDYSEGDAVIVRQGAGDASSFA

SEQ ID NO: 14689 - DNA, 627 bp, Rickettsiella grylli
  CDS (1)..(627): transl_table=11
atgagccaatttcttaaaattcacaaagaaaatccgcagctgcatttaatacgtatggcagcaaatatcgtgatgaaagagggggttattgtttatccaacagactctgcttatgcattagggtgtcaactcaccaacaaaaagggaatacaacgcattaaacaaatacgtcagttaaaagaccaacattctctgaccttactgtgtcgtgatatttctgaaatggctcattttgcgcaattagagacccctatttttcgtttaataaaagccaatacaccaggtccttacacttttttattaccggcgacatcgcatgtaccacgttatttaatccatgcgaagcgtaaaaccattgggatacggattccagacaataaaatagtgcatgcgttattagaaatgaatgatcaaccgttaatcaacacgacgttgattttacccgattctgatctccctttattagaaccggaagcaattcgcgatattttagggaaacgagtggacttagtgattgatggtgggttttgcggtttagaactgacaaccgtcattgacttatcaggacacattccgcacattattcgttgtggtaaaggagagattaaacctttccaacccatttga

SEQ ID NO: 14690 - protein, 208 aa, Rickettsiella grylli
MSQFLKIHKENPQLHLIRMAANIVMKEGVIVYPTDSAYALGCQLTNKKGIQRIKQIRQLKDQHSLTLLCRDISEMAHFAQLETPIFRLIKANTPGPYTFLLPATSHVPRYLIHAKRKTIGIRIPDNKIVHALLEMNDQPLINTTLILPDSDLPLLEPEAIRDILGKRVDLVIDGGFCGLELTTVIDLSGHIPHIIRCGKGEIKPFQPI

SEQ ID NO: 14691 - DNA, 624 bp, Thauera sp. MZ1T
  CDS (1)..(624): transl_table=11
atggcccagtatttctcccttcatcccgaacagccgcaggcgcggctgatccgtcaggccgccgagatcctgcgtggcggcggcctcgtcgcgctgcccaccgactccgcctacgcgctcgcctgccaggtcggcgacgccgcgctgctcgaccgcatccgccgcatccgcggggtggatgagcgccaccacttcacgctgatgtgccgcgacctctccgagatcggcacctacgcccgggtggacaacagccagtaccggttgctgaaggcggtcactcccggcccctacaccttcatcctcgaaggcaccaaggagctgccgcgccgcgtgctgcacccgaagcgcaagaccatcggcctgcgcgtgcccgagcacgcggtggtgtcggccctgctcgccgagatcgacggcccgctgctgacctcgaccctgatcctgcccggcgaggacctgccgctctccgacccggaggagatccgcgaccgtctcggcaagctggtcgagctggtcatcgaggccggctactgcggtcccgaggccaccaccgtgatcgacctcacctcgggtgcgcccgagctggtacgcgccgggcgcggcccgctcgagcccttcggtctgtag

SEQ ID NO: 14692 - protein, 207 aa, Thauera sp. MZ1T
MAQYFSLHPEQPQARLIRQAAEILRGGGLVALPTDSAYALACQVGDAALLDRIRRIRGVDERHHFTLMCRDLSEIGTYARVDNSQYRLLKAVTPGPYTFILEGTKELPRRVLHPKRKTIGLRVPEHAVVSALLAEIDGPLLTSTLILPGEDLPLSDPEEIRDRLGKLVELVIEAGYCGPEATTVIDLTSGAPELVRAGRGPLEPFGL

SEQ ID NO: 14693 - DNA, 954 bp, Oryza sativa subsp
  CDS (1)..(954)
atggccaccgccaccgccacggcgaccgccgccgccgccgccgcgtcctcctcgcgcctccccttccgccgcgccgcctcctcctcctcctcctcctcgcagctccgcctccccgcggtgcctcctccccaccgcgcctccttcgccgtcgtcgccctccacaagcgcaaccccaagcggctcaagtacgcctcccagcgccagttcacgagaggggatgccgggatgctgcgggtgcaggtggagccatccggcgaggacgcgtggaagctggagcccgtcgtcgaactcatcaaccgcggcgccgtcggcatcatccctaccgacaccgtctactccatcgtctgtgatctcagtaacaatgactctgtcgagcgccttcgcaggatcaaaggcattggagattcaaaggcaagatatgcaaagaccatcttgtgccgctcgctacgagacattgatacctacacaaccggatttcctcgaggcactaaccaagggcaagctaacatatttcgtgctgtcaagcgtgtaatacctgggccttacacctttattttacctgcaaccaaggaattgcccaaacaatgcataaggcatggatcatctactaggtacgcgaaaaggaggcaggttggtgtccgacttccagatgaccccatatgtgaagcaatattgcaaaatcttgatgagcctttgatctgcacaagtgtcaaatctctgtcagaggatgaatggatacttgacccggttatcattgctgatatatatgagcaacagggccttgatttcattgtcgatggaggtactagaattgctgacccgtctactgtggttgatatgacgggaagctaccctaccatcattcgtcagggaaagggccctaagctagattggatggtagcggaagatgaggaacaagagtcgcgaccaacatttgcgtataaagcagcttga

SEQ ID NO: 14694 - protein, 317 aa, Oryza sativa subsp
MATATATATAAAAAASSSRLPFRRAASSSSSSSQLRLPAVPPPHRASFAVVALHKRNPKRLKYASQRQFTRGDAGMLRVQVEPSGEDAWKLEPVVELINRGAVGIIPTDTVYSIVCDLSNNDSVERLRRIKGIGDSKARYAKTILCRSLRDIDTYTTGFPRGTNQGQANIFRAVKRVIPGPYTFILPATKELPKQCIRHGSSTRYAKRRQVGVRLPDDPICEAILQNLDEPLICTSVKSLSEDEWILDPVIIADIYEQQGLDFIVDGGTRIADPSTVVDMTGSYPTIIRQGKGPKLDWMVAEDEEQESRPTFAYKAA

SEQ ID NO: 14695 - DNA, 951 bp, Oryza sativa subsp
  CDS (1)..(951)
atggccaccgccaccgccacggcgaccgccgccgccgccgccgcgtcctcctcgcgcctccccttccgccgcgccgcctcctcctcctcctcctcgcagctccgcctccccgcggtgcctcctccccaccgcgcctccttcgccgtcgtcgccctccacaagcgcaaccccaagcggctcaagtacgcctcccagcgccagttcacgagaggggatgccgggatgctgcgggtgcaggtggagccatccggcgaggacgcgtggaagctggagcccgtcgtcgaactcatcaaccgcggcgccgtcggcatcatccctaccgacaccgtctactccatcgtctgtgatctcagtaacaatgactctgtcgagcgccttcgcaggatcaaaggcattggagattcaaaggcaagatatgcaaagaccatcttgtgccgctcgctacgagacattgatacctacacaaccggatttcctcgaggcactaaccaagggcaagctaacatatttcgtgctgtcaagcgtgtaatacctgggccttacacctttattttacctgcaaccaaggaattgcccaaacaatgcataaggcatggatcatctactaggtacgcgaaaaggaggcaggttggtgtccgacttccagatgaccccatatgtgaagcaatattgcaaaatcttgatgagcctttgatctgcacaagtgtcaaatctctgtcagaggatgaatggatacttgacccggttatcattgctgatatatatgagcaacagggccttgatttcattgtcgatggaggtactagaattgctgacccgtctactgtggttgatatgacgggaagctaccctaccatcattcgtcagggaaagggccctaagctagattggatggtagcggaagatgaggaacaagagtcgcgaccaacatttgcgtataaagcagcttga

SEQ ID NO: 14696 - protein, 316 aa, Oryza sativa subsp
MATATATATAAAAAASSSRLPFRRAASSSSSSQLRLPAVPPPHRASFAVVALHKRNPKRLKYASQRQFTRGDAGMLRVQVEPSGEDAWKLEPVVELINRGAVGIIPTDTVYSIVCDLSNNDSVERLRRIKGIGDSKARYAKTILCRSLRDIDTYTTGFPRGTNQGQANIFRAVKRVIPGPYTFILPATKELPKQCIRHGSSTRYAKRRQVGVRLPDDPICEAILQNLDEPLICTSVKSLSEDEWILDPVIIADIYEQQGLDFIVDGGTRIADPSTVVDMTGSYPTIIRQGKGPKLDWMVAEDEEQESRPTFAYKAA

SEQ ID NO: 14697 - DNA, 642 bp, Microcystis aeruginosa PCC 7806
  CDS (1)..(642): transl_table=11
atggctactatttactctctccatccggaaaatccccaacaacgttctatccaagaaatctgtcatgccctgaaaaatggggcaattatgctttatcctaccgataccgtctatgcgatcggttgcgatctcaatgtgaaatccgccgtcgaacgagttcgccaaatcaagcaactatctaatgataaacccttgacgtttctctgttcttctttgtcgaatatttccgagtacgcagtggtaagcgattatgcttataaaattatgcgacgagttatacccggtccctacacttttctcttaccggcgactaaattagtgccgaaagtggtgatgaatccgaagcggaaaaccaccggtatccgggttcccgatcacgttatctgtcgcactattctcgaaaccctagaaaatcccattatctctagttctgcccatcttcccgatcaggagggggattttcccaccaaggggttagaaaccgctaggctattcgatgccctcgatcatgtagttgatttaattatcgaagatggttcggctcccggttcggaagtgtcaaccattgttgattttaccagcgatcaaccggatatcgtgcgtcagggtttgggttggccagaattacaacaatggttataa

SEQ ID NO: 14698 - protein, 213 aa, Microcystis aeruginosa PCC 7806
MATIYSLHPENPQQRSIQEICHALKNGAIMLYPTDTVYAIGCDLNVKSAVERVRQIKQLSNDKPLTFLCSSLSNISEYAVVSDYAYKIMRRVIPGPYTFLLPATKLVPKVVMNPKRKTTGIRVPDHVICRTILETLENPIISSSAHLPDQEGDFPTKGLETARLFDALDHVVDLIIEDGSAPGSEVSTIVDFTSDQPDIVRQGLGWPELQQWL

SEQ ID NO: 14699 - DNA, 942 bp, Populus jackii
  CDS (1)..(942)
atggcggaaacaaaactatacggttacaaactgactccatcactctcatctctaccctctttaacaactctacgacgacatgtcgctccatttccaagcctagtttcctttaacaccccaaaaccccctcgcctccgtgtcttatccatggctattaaaagaagcccaaaacgactcaagtactctgctcctcgttttaccaaggaggacggactgctttatgtggaagctgacgagttaggatctgacacgtggaagttggaacctgtgattgagcttttgaaacaaggagctgttggtgttattcctactgatactgtgtatgcgattgtttgtgatttgaaaagcaactcagcaattgaacgtcttcgtagaattaaaaacatagaaccttccaagcctcttagcatcttgtgccactctctgagagacatagatacatatacgactggattcccacgtggtgatggtcaaggtcatgctgatatatttcgagccgttaagcattgcttaccagggccatataccttcatcctaactgcaagcaaagaactaccaaaacagtgtgtgcggtttgggactacaactgccaaatatgcttcaaggaaaaatgtgggtatccgaatgcctgatgatgctatttgtcaagcaatcctagagaagatggatgcaccacttatatccacaagtgtcaggtcgccaaaggaaaacgagtggatgattgatccagttgtaatagctgatatatatggactagagggtcttgattttgttgttaatggaggcatcagagtggctgatccatctactgtagttgacatgacaggaagttctccaaaaattatacggcaaggaaaggggcctaaattacactggatggtagctgaagatgacgatgaatctgcttttcatgttgaagatctcatacattctgctacttaa

SEQ ID NO: 14700 - protein, 313 aa, Populus jackii
MAETKLYGYKLTPSLSSLPSLTTLRRHVAPFPSLVSFNTPKPPRLRVLSMAIKRSPKRLKYSAPRFTKEDGLLYVEADELGSDTWKLEPVIELLKQGAVGVIPTDTVYAIVCDLKSNSAIERLRRIKNIEPSKPLSILCHSLRDIDTYTTGFPRGDGQGHADIFRAVKHCLPGPYTFILTASKELPKQCVRFGTTTAKYASRKNVGIRMPDDAICQAILEKMDAPLISTSVRSPKENEWMIDPVVIADIYGLEGLDFVVNGGIRVADPSTVVDMTGSSPKIIRQGKGPKLHWMVAEDDDESAFHVEDLIHSAT

SEQ ID NO: 14701 - DNA, 927 bp, Ostreococcus tauri
  CDS (1)..(927)
atggcgcgcgcgcgcgtgggaaccggaacgataacgcgcgcgtcgcgaccggtgcgcgcgcggtgcgcgcgcgggcgaacgacgacgcgacggcgaaaggtggacgccgccgccggaaagccgcgcatcgcgaccgtcgcgcgcggacgacgcgggcgcggcgtcgaggacggtggtgggacgccgtcgcgcgcgatgttcgtcgagatggatctggatttggtcggactcgagggtgagcgatggaagctggacgcggtggcggaggcgattcgacgcggcgcggtgggcgcgataccgaccgatacgaagtacgccttcgtggcggatatgtcgaacgcgagcgcggtacaaaagttgtacgatatcaaggggtgtggatataataaaccgttgagcattctgtgcagggggttcgcggatatcgacgcgtacacgacggggttcccgaaaaacgtgaaaccgggggagacgctgccgttcaaattggcgaagaagtgcctgccgggaccgtacacgttcatcttaccggcgtcgaaggagttgccaaaggtgtgcctcggcgataactcgaccaaggagaaggcgaagcagtgcaaatcgagaaagactgtcggcgtgcggattccggactgcgacgtcacgcgcgccttgctcgatctcttggacgcccctctgatgtgttcgaccgtcccggagtgcgacgacgaaccggcagtgatctacgacgagtatctctcgcgcggtttggggttcatgattgacaccggtgagcgccgcgcgtccgcggcgagcaccgtcgtcgacttgtcgtcgggcgagccgcgcatcttacgccgcggcgcgggcgatccgaacgtctggagctccatcgacgaggaagaactcgtcgagagcgacgacgacgccgcgtggggattcgcgtga

SEQ ID NO: 14702 - protein, 308 aa, Ostreococcus tauri
MARARVGTGTITRASRPVRARCARGRTTTRRRKVDAAAGKPRIATVARGRRGRGVEDGGGTPSRAMFVEMDLDLVGLEGERWKLDAVAEAIRRGAVGAIPTDTKYAFVADMSNASAVQKLYDIKGCGYNKPLSILCRGFADIDAYTTGFPKNVKPGETLPFKLAKKCLPGPYTFILPASKELPKVCLGDNSTKEKAKQCKSRKTVGVRIPDCDVTRALLDLLDAPLMCSTVPECDDEPAVIYDEYLSRGLGFMIDTGERRASAASTVVDLSSGEPRILRRGAGDPNVWSSIDEEELVESDDDAAWGFA

SEQ ID NO: 14703 - DNA, 603 bp, Streptomyces coelicolor
  CDS (1)..(603): transl_table=11
gtgcaccccgacaacccccagccgcgcagcatcgcccaggtcgccgacagcgtccgctccggcgcgctgatcgcgtatccgacggactcctgctacgcactgggctgccgactgggcagccgcgacgggatcgaccgcatccggtcgatccggcagctggacaaccggcaccacttcaccctcgtctggcaggacttcgcgcagctcgggcagttcgtgcagatcgacaacgacgtgttccgggcgatcaaggcctcgacgcccggcagctacaccttcatcctgcccgcgacgagggaggtgccgcgcgcgctccagcacccgaagaagaagacggtgggcgtgcgcatccccgaccacgtcgtcacccaggccctgctcgccgagctcggtgaaccgctgctgtccagcacgctgttgctgcccgacgaggaggagccgatgacgcagggctgggagatcaaggaccggctcgaccacgtgctggacgcggtcgtcgactccggggactgcggcaccgagcccaccacggtcgtcgacttctccggcggcgaggcggagatcgtgcggcacggcgcgggcgacacgacccggttcgagtag

SEQ ID NO: 14704 - protein, 200 aa, Streptomyces coelicolor
MHPDNPQPRSIAQVADSVRSGALIAYPTDSCYALGCRLGSRDGIDRIRSIRQLDNRHHFTLVWQDFAQLGQFVQIDNDVFRAIKASTPGSYTFILPATREVPRALQHPKKKTVGVRIPDHVVTQALLAELGEPLLSSTLLLPDEEEPMTQGWEIKDRLDHVLDAVVDSGDCGTEPTTVVDFSGGEAEIVRHGAGDTTRFE

SEQ ID NO: 14705 - DNA, 624 bp, Haemophilus influenzae
  CDS (1)..(624): transl_table=11
atgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaagggtaaataataccgcttatcgtttgattaaaaataatacgccagggcgttatacttttattcttacagcaacgaaagaattaccgcgtcgtttaatgacatcaaaacgtaaaaccattggtttacgcgtaccagataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaa

SEQ ID NO: 14706 - protein, 207 aa, Haemophilus influenzae
MSQFFYIHPENPQARLINQAVEILQKGGVIVYPTDSGYALGCMMGDKHAMDRIVAIRKLPEGHNFTLVCSDLSELSTYARVNNTAYRLIKNNTPGRYTFILTATKELPRRLMTSKRKTIGLRVPDNKIALDLLSALGEPILSCSLMLPNEEHTTQSDPEEIRDRLEHQVDLIIHGGYLGQEPTTVVDLTEESPVILREGSGSTAPFI

SEQ ID NO: 14707 - DNA, 942 bp, Oryza sativa
  CDS (1)..(942)
atggccaccgccaccgccacggcgaccgccgccgccgccgccgcgtcctcctcgcgcctccccttccgccgcgccgcctcctcctcctcctcctcgcagctccgcctccccgcggtgcctcctccccaccgcgcctccttcgccgtcgtcgccctccacaagcgcaaccccaagcggctcaagtacgcctcccagcgccagttcacgagaggggatgccgggatgctgcgggtgcaggtggagccatccggcgaggacgcgtggaagctggagcccgtcgtcgaactcatcaaccgcggcgccgtcggcatcatccctaccgacaccgtctactccatcgtctgtgatctcagtaacaatgactctgtcgagcgccttcgcaggatcaaaggcattggagattcaaagcctctcagcatcttgtgccgctcgctacgagacattgatacctacacaaccggatttcctcgaggcactaaccaagggcaagctaacatatttcgtgctgtcaagcgtgtaatacctgggccttacacctttattttacctgcaaccaaggaattgcccaaacaatgcataaggcatggatcatctactaggtacgcgaaaaggaggcaggttggtgtccgacttccagatgaccccatatgtgaagcaatattgcaaaatcttgatgagcctttgatctgcacaagtgtcaaatctctgtcagaggatgaatggatacttgacccggttatcattgctgatatatatgagcaacagggccttgatttcattgtcgatggaggtactagaattgctgacccgtctactgtggttgatatgacgggaagctaccctaccatcattcgtcagggaaagggccctaagctagattggatggtagcggaagatgaggaacaagagtcgcgaccaacatttgcgtataaagcagcttga

SEQ ID NO: 14708 - protein, 313 aa, Oryza sativa
MATATATATAAAAAASSSRLPFRRAASSSSSSQLRLPAVPPPHRASFAVVALHKRNPKRLKYASQRQFTRGDAGMLRVQVEPSGEDAWKLEPVVELINRGAVGIIPTDTVYSIVCDLSNNDSVERLRRIKGIGDSKPLSILCRSLRDIDTYTTGFPRGTNQGQANIFRAVKRVIPGPYTFILPATKELPKQCIRHGSSTRYAKRRQVGVRLPDDPICEAILQNLDEPLICTSVKSLSEDEWILDPVIIADIYEQQGLDFIVDGGTRIADPSTVVDMTGSYPTIIRQGKGPKLDWMVAEDEEQESRPTFAYKAA

SEQ ID NO: 14709 - DNA, 954 bp, Zea mays
  CDS (1)..(954)
atggccgccgttgcctcctccttctcgcggttctccttccgctgcgccgtctgcccctccccgctccgcgtccgcttttcgcagccccatccgcccgcgcggctccgcgtctcctccaccgtcgttgctctccacaagcgcaaccccaagcggctcaagtacgccgccgagcgccagttcacgtctctttggtggctgggttttgcgcgaacgaagagaggggatgccgggttgctgcgggtggaggtggagccctccggcggggacttctggaagcttgaccccattatcgacctcatcaatcgcggcgccgtcggggtgatccctactgacaccgtctactccgtcgtctgtgacctgagtaacaatgaatcgattgagcgccttcgcagactgaaaggaattggagactccaagcctctcagcatcctgtgtcgctcattacgtgacatcgatacctacacaacaggatttcctcaaggcactaaccaagggcaagctaacatttttcgtgttgtcaagcgtgcaatacctgggccttacacatttattttacctgcaagcaagcagtttcctaaacaatgtataaagcatggttcttccacaaggtatgcaaaaaggaggcaggttggcgtccgaattccagatgatcccatctgccaggcaatattgcaaaatcttgatgaacctttgatatgcacaagtgtcaaatatctatcggaggatgaatggatacttgatccagtaatcattgcagatctttatgagccactggggcttgattttattgttgatggcggacctagaattgctgacccttctaccgtagtagatatgatgggagcaaaccctactgtaattcgtcagggaaagggtctaaagttggattggatggtagcaaaagatgaagaggaggacgaggcacagtcgatgttttctttcaaatcagcttga

SEQ ID NO: 14710 - protein, 317 aa, Zea mays
MAAVASSFSRFSFRCAVCPSPLRVRFSQPHPPARLRVSSTVVALHKRNPKRLKYAAERQFTSLWWLGFARTKRGDAGLLRVEVEPSGGDFWKLDPIIDLINRGAVGVIPTDTVYSVVCDLSNNESIERLRRLKGIGDSKPLSILCRSLRDIDTYTTGFPQGTNQGQANIFRVVKRAIPGPYTFILPASKQFPKQCIKHGSSTRYAKRRQVGVRIPDDPICQAILQNLDEPLICTSVKYLSEDEWILDPVIIADLYEPLGLDFIVDGGPRIADPSTVVDMMGANPTVIRQGKGLKLDWMVAKDEEEDEAQSMFSFKSA

SEQ ID NO: 14711 - DNA, 921 bp, Zea mays
  CDS (1)..(921)
atggccgccgttgcctcctccttctcgcggttctccttccgctgcgccgtctgcccctccccgctccgcgtccgcttttcgcagccccatccgcccgcgcggctccgcgtctcctccaccgtcgttgctctccacaagcgcaaccccaagcggctcaagtacgccgccgagcgccagttcacgagaggggatgccgggttgctgcgggtggaggtggagccctccggcggggacttctggaagcttgaccccattatcgacctcatcaatcgcggcgccgtcggggtgatccctactgacaccgtctactccgtcgtctgtgacctgagtaacaatgaatcgattgagcgccttcgcagactgaaaggcattggagactccaagcctctcagcatcctgtgtcgctcattacgtgacatcgatacctacacaacaggatttcctcaaggcactaaccaagggcaagctaacatttttcgtgttgtcaagcgtgcaatacctgggccttacacatttattttacctgcaagcaagcagtttcctaaacaatgtataaagcatggttcttccacaaggtatgcaaaaaggaggcaggttggcgtccgaattccagatgatcccatctgccaggcaatattgcaaaatcttgatgaacctttgatatgcacaagtgtcaaatatctatcggaggatgaatggatacttgatccagtaatcattgcagatctttatgagccactggggcttgattttattgttgatggcggacctagaattgctgacccttctaccgtagtagatatgatgggagcaaaccctactgtaattcgtcagggaaagggtctaaagttggattggatggtagcaaaagatgaagaggaggacgaggcacagtcgatgttttctttcaaatcagcttga

SEQ ID NO: 14712 - protein, 306 aa, Zea mays
MAAVASSFSRFSFRCAVCPSPLRVRFSQPHPPARLRVSSTVVALHKRNPKRLKYAAERQFTRGDAGLLRVEVEPSGGDFWKLDPIIDLINRGAVGVIPTDTVYSVVCDLSNNESIERLRRLKGIGDSKPLSILCRSLRDIDTYTTGFPQGTNQGQANIFRVVKRAIPGPYTFILPASKQFPKQCIKHGSSTRYAKRRQVGVRIPDDPICQAILQNLDEPLICTSVKYLSEDEWILDPVIIADLYEPLGLDFIVDGGPRIADPSTVVDMMGANPTVIRQGKGLKLDWMVAKDEEEDEAQSMFSFKSA

SEQ ID NO: 14713 - DNA, 22 bp, Artificial sequence
  primer
atgggaacagccgcagaacacc

SEQ ID NO: 14714 - DNA, 24 bp, Artificial sequence
  primer
ttataagaaaggcttcacatcacc

SEQ ID NO: 14715 - protein, 240 aa, Artificial sequence
  consensus sequence
  Variant (2)..(3): Xaa in position 2 to 3 is any amino acid
  Variant (6)..(6): Xaa in position 6 is any amino acid
  Variant (7)..(8): Xaa in position 7 to 8 is any or no amino acid
  Variant (10)..(20): Xaa in position 10 to 20 is any amino acid
  Variant (22)..(26): Xaa in position 22 to 26 is any amino acid
  Variant (30)..(31): Xaa in position 30 to 31 is any amino acid
  Variant (34)..(35): Xaa in position 34 to 35 is any amino acid
  Variant (37)..(45): Xaa in position 37 to 45 is any amino acid
  Variant (47)..(62): Xaa in position 47 to 62 is any amino acid
  Variant (63)..(65): Xaa in position 63 to 65 is any or no amino acid
  Variant (67)..(68): Xaa in position 67 to 68 is any amino acid
  Variant (70)..(74): Xaa in position 70 to 74 is any amino acid
  Variant (76)..(83): Xaa in position 76 to 83 is any amino acid
  Variant (84)..(91): Xaa in position 84 to 91 is any or no amino acid
  Variant (93)..(94): Xaa in position 93 to 94 is any amino acid
  Variant (96)..(98): Xaa in position 96 to 98 is any amino acid
  Variant (101)..(101): Xaa in position 101 is any amino acid
  Variant (105)..(105): Xaa in position 105 is any amino acid
  Variant (107)..(108): Xaa in position 107 to 108 is any amino acid
  Variant (110)..(112): Xaa in position 110 to 112 is any amino acid
  Variant (114)..(120): Xaa in position 114 to 120 is any amino acid
  Variant (121)..(133): Xaa in position 121 to 133 is any or no amino acid
  Variant (135)..(135): Xaa in position 135 is any amino acid
  Variant (137)..(137): Xaa in position 137 is any amino acid
  Variant (139)..(139): Xaa in position 139 is any amino acid
  Variant (141)..(147): Xaa in position 141 to 147 is any amino acid
  Variant (150)..(151): Xaa in position 150 to 151 is any amino acid
  Variant (153)..(154): Xaa in position 153 to 154 is any amino acid
  Variant (156)..(180): Xaa in position 156 to 180 is any amino acid
  Variant (181)..(195): Xaa in position 181 to 195 is any or no amino acid
  Variant (197)..(209): Xaa in position 197 to 209 is any amino acid
  Variant (210)..(218): Xaa in position 210 to 218 is any or no amino acid
  Variant (221)..(221): Xaa in position 221 is any amino acid
  Variant (223)..(230): Xaa in position 223 to 230 is any amino acid
  Variant (231)..(235): Xaa in position 231 to 235 is any or no amino acid
  Variant (237)..(237): Xaa in position 237 is any amino acid
  Variant (239)..(239): Xaa in position 239 is any amino acid
PXXPQXXXRXXXXXXXXXXXGXXXXXPTDXXYAXXCXXXXXXXXXRXXXXXXXXXXXXXXXXXXXCXXLXXXXXYXXXXXXXXXXXXXXXXRXXKXXXPGXYTFXLXXTXXXPXXXXXXXXXXXXXXXXXXXXTXGXRXPXXXXXXXLLXXLXXPXXXXXXXXXXXXXXXXXXXXXXXXXXXXXXXXXXXXXXXXDXXXXXXXXXXXXXXXXXXXXXXTVXDXXXXXXXXXXXXXRXGXG

SEQ ID NO: 14716 - protein, 22 aa, Artificial sequence
  protein pattern
  Variant (2)..(2): Xaa in position 2 is any amino acid
  Variant (3)..(3): Xaa in position 3 is Ile, Leu, Met or Val
  Variant (5)..(6): Xaa in position 5 to 6 is any amino acid
  Variant (7)..(7): Xaa in position 7 is any or no amino acid
  Variant (9)..(9): Xaa in position 9 is Gly or Asn
  Variant (10)..(10): Xaa in position 10 is any amino acid
  Variant (11)..(11): Xaa in position 11 is Phe, Trp or Tyr
  Variant (12)..(12): Xaa in position 12 is Thr or Val
  Variant (14)..(14): Xaa in position 14 is Ile, Leu or Val
  Variant (15)..(15): Xaa in position 15 is Phe or Leu
  Variant (16)..(16): Xaa in position 16 is any amino acid
  Variant (17)..(17): Xaa in position 17 is Ala or Gly
  Variant (18)..(18): Xaa in position 18 is Ser or Thr
  Variant (19)..(21): Xaa in position 19 to 21 is any amino acid
RXXKXXXPXXXXFXXXXXXXXP

SEQ ID NO: 14717 - protein, 30 aa, Artificial sequence
  protein pattern
  Variant (2)..(13): Xaa in position 2 to 13 is any amino acid
  Variant (14)..(15): Xaa in position 14 to 15 is any or no amino acid
  Variant (17)..(17): Xaa in position 17 is Ala or Gly
  Variant (18)..(18): Xaa in position 18 is Ile, Leu or Val
  Variant (19)..(19): Xaa in position 19 is Ile, Met or Val
  Variant (20)..(21): Xaa in position 20 to 21 is any amino acid
  Variant (25)..(25): Xaa in position 25 is Cys, Ser or Thr
  Variant (26)..(26): Xaa in position 26 is any amino acid
  Variant (28)..(28): Xaa in position 28 is Ala or Gly
  Variant (29)..(29): Xaa in position 29 is Phe, Ile, Leu or Val
  Variant (30)..(30): Xaa in position 30 is Ala, Gly or Val
PXXXXXXXXXXXXXXGXXXXXPTDXXYXXX

SEQ ID NO: 14718 - DNA, 1062 bp, Escherichia coli
  CDS (1)..(1062): transl_table=11
atgaccgaaccgttaaaaccacgtattgatttcgacggtcctctggaggtcgatcagaatcctaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggagggctggctctgtttggcgcaagcgttgtcgggcagggtgtacagtggacaatgaatgcctggcaaacccaggactgggtggcgctgggtggatgtgccgctggggcattgattatcggcgctggcgtaggttctgtggtaacagagtggcggcgcttatggcgcttgcgacagcgcgcccatgaacgcgacgaagcgcgtgatttattgcatagccacggcacgggcaaaggccgcgcattttgcgaaaaactggcgcagcaggcgggtattgatcagtcgcatccggcgctgcaacgctggtatgcctcaatccatgaaacgcaaaacgaccgtgaagtggtcagcctgtatgcgcatttggtccagccagttttagatgcccaggcgcggcgcgaaatcagccgttcggcggcggaatcaacgttgatgattgcggtcagcccgctggcgttggtcgatatggcgtttatcgcctggcgcaatctgcgtttaattaatcgcatcgccacgctgtatggcattgaactggggtattacagccgtttgcgtctgtttaagctggtattgctgaatatcgcttttgccggagccagcgaactggtgcgcgaagtggggatggactggatgtcgcaagatctcgctgctcgtttgtctacccgcgcagctcaggggattggtgcaggacttctgacggcacgactcgggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataa

SEQ ID NO: 14719 - protein, 353 aa, Escherichia coli
MTEPLKPRIDFDGPLEVDQNPKFRAQQTFDENQAQNFAPATLDEAQEEEGQVEAVMDAALRPKRSLWRKMVMGGLALFGASVVGQGVQWTMNAWQTQDWVALGGCAAGALIIGAGVGSVVTEWRRLWRLRQRAHERDEARDLLHSHGTGKGRAFCEKLAQQAGIDQSHPALQRWYASIHETQNDREVVSLYAHLVQPVLDAQARREISRSAAESTLMIAVSPLALVDMAFIAWRNLRLINRIATLYGIELGYYSRLRLFKLVLLNIAFAGASELVREVGMDWMSQDLAARLSTRAAQGIGAGLLTARLGIKAMELCRPLPWIDDDKPRLGDFRRQLIGQVKETLQKGKTPSEK

SEQ ID NO: 14720 - DNA, 1074 bp, Haemophilus somnus 2336
  CDS (1)..(1074): transl_table=11
atgccaaaaaaggtttttcaacaagaagatgttgagcaaaaaatcacagaaaattttgagcctaaacaagaatttgagcaagacgaattagatatagaaatggactgctctcaatttgaaacaacaatggatcggcaaaatacagatattccttttcagcatatggttagaccaaaagtgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggaacaataataaaagaatggcgacgtttagttcaactaaaaaagcgtttgatattacaagaaaaaagccgagaaattcgctcaaaaagtgcggttaatttaactgaggtttcttctgagggcaaagagttgtgtttaaaaattgcctcgcttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagctattgtggatatgttctttatcgcttggcgtaatattcgtttgattaatcaattagcaaaactttatggtattgagttgggctatgttagtcgtctccgtttgttacgcatggtttttgttaatatggcatttgccggtgcggcagaagtcattcaagatctcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtag

SEQ ID NO: 14721 - protein, 357 aa, Haemophilus somnus 2336
MPKKVFQQEDVEQKITENFEPKQEFEQDELDIEMDCSQFETTMDRQNTDIPFQHMVRPKVTMWQKLLMATICLFSCGILAQSVQWLVDSWRDNQWIAFVFAMVSLFLVLLGLGTIIKEWRRLVQLKKRLILQEKSREIRSKSAVNLTEVSSEGKELCLKIASLMGIDDKSPQLIAWQEQVHEAYTEQEILRLFSQNVLIPFDRVAKKLISKNAVESALIVAVSPLAIVDMFFIAWRNIRLINQLAKLYGIELGYVSRLRLLRMVFVNMAFAGAAEVIQDLGLEWLSQDITAKLSARVAQGIGVGILTARLGIKAMEFCRPIAVAPEEKLRLSHIQTELLGTLKTTLFSANKVKEKVR

SEQ ID NO: 14722 - DNA, 1062 bp, Salmonella enterica subsp. arizonae serovar 62:z4,z23:--
  CDS (1)..(1062): transl_table=11
atgagcgagccgttaaaaccgcgtattgattttgcagaacccttgaaggaggagtcaacatcgaccttcaaagcgcagcaaaccttcagcgaagtggagtcgcgcacattttcgcctgcggctatcgatgagtatcctgaagatgaaggaacagcagaagcggcagtcgatgctgcgctgcaacccaagcgtagtctgtggcgtaaaatggtactgggggggctggcgctgtttggcgcgagcgtggtagggcaaggcatacagtggacaatgaatgcctggcaaacccaggactgggccgccttaggcggctgtgccgcaggcgcgctgatcattggcgctggcgtgggatcggtgattacagagtggcggcgattatggcgattgcgtcaacgggcgcatgagcgggatgaggcgcgtgaactgttacatagccatagcgtcgggaaaggtcgcgcatactgcgaaaaactggcgcagcaggcgggaattgatcaatctcatccggcattacagcgctggtatgccgccattcatgaaacgcaaaacgacagagaaatcgttggtctgtatgcgcatctggtgcagccggtgctcgacgcccaggcacggcgtgaggttagccgttttgctgcggaatcgactctgatgattgccgtaagcccgttagcgctagtggatatggcgtttattgcatggcgtaacttgcgtctcattaaccgcatcgcagcgctgtatggcattgaacttggttattacagccgccttcgtctgttccgtctggtgttgctgaatatcgcttttgcaggagccagtgagctggtgcgcgaagtcggtatggactggatgtcgcaggatctggcggcacgcctgtccacgcgcgccgcgcaggggattggcgcagggctgcttacggcccggttggggataaaaaccatggagttatgtcgtccattgccgtggtttgacgacgataaaccacgtctcggcgattttcgccgacagcttattggtcagctaaaagagacactacagaagaacaagcccacacctgaaaaataa

SEQ ID NO: 14723 - protein, 353 aa, Salmonella enterica subsp. arizonae serovar 62:z4,z23:--
MSEPLKPRIDFAEPLKEESTSTFKAQQTFSEVESRTFSPAAIDEYPEDEGTAEAAVDAALQPKRSLWRKMVLGGLALFGASVVGQGIQWTMNAWQTQDWAALGGCAAGALIIGAGVGSVITEWRRLWRLRQRAHERDEARELLHSHSVGKGRAYCEKLAQQAGIDQSHPALQRWYAAIHETQNDREIVGLYAHLVQPVLDAQARREVSRFAAESTLMIAVSPLALVDMAFIAWRNLRLINRIAALYGIELGYYSRLRLFRLVLLNIAFAGASELVREVGMDWMSQDLAARLSTRAAQGIGAGLLTARLGIKTMELCRPLPWFDDDKPRLGDFRRQLIGQLKETLQKNKPTPEK

SEQ ID NO: 14724 - DNA, 1062 bp, Salmonella enterica subsp. enterica serovar Paratyphi B str. SPB7
  CDS (1)..(1062): transl_table=11
atgagcgaaccgttaaaaccgcgtattgattttgcagaaccgctaaaggaggagcctacgtcggccttcaaagcgcagcaaactttcagcgaagcggagtcgcgtacatttgcgcctgcagctatcgatgagcgcccggaagacgaaggcgtggcagaagcggcggtcgatgccgcgctgcgccccaaacgcagcctgtggcgtaaaatggtgatgggaggactggcgctgtttggcgcgagcgtggtcgggcaaggcgtacagtggacaatgaatgcctggcaaactcaggactgggtcgctttaggcggctgtgccgcaggcgcgctgatcgttggcgctggcgtgggatcggtggtcacggagtggcggcgattatggcgcttgcgccagcgggcgcatgagcgcgatgaggcgcgtgaactgttacatagccatagcgtcgggaaaggtcgcgcattttgcgaaaaactggcgcagcaggcggggattgatcaatcacatccggcattacaacgttggtatgccgctattcacgaaacgcaaaacgacagggaaatcgtcggcttgtatgcgcatctggtacagccggtacttgacgcgcaggcgcgacgtgagattagccgtttcgccgcggaatcgactctgatgatcgccgtcagtccgttagcgttggtggatatggcgtttattgcctggcgtaatttacgcctgattaaccgtatcgcaacgctgtatggcattgaacttggttattacagccgccttcgtctgttccgtctggtgttgctgaatatcgcgttcgcgggggccagtgagctgatgcgtgaagtcggtatggactggatgtctcaggatctggccgcacgcttgtccacgcgcgcggcgcaggggattggcgcaggcctccttaccgctcgactgggaataaaagcgatggagctatgtcggccattgccgtggatcgacaacgataaaccacgtctcggtgattttcgtcgtcagcttatcggtcagctaaaagagaccctgcaaaagagtaagtcgtcgccggagaaatga

SEQ ID NO: 14725 - protein, 353 aa, Salmonella enterica subsp. enterica serovar Paratyphi B str. SPB7
MSEPLKPRIDFAEPLKEEPTSAFKAQQTFSEAESRTFAPAAIDERPEDEGVAEAAVDAALRPKRSLWRKMVMGGLALFGASVVGQGVQWTMNAWQTQDWVALGGCAAGALIVGAGVGSVVTEWRRLWRLRQRAHERDEARELLHSHSVGKGRAFCEKLAQQAGIDQSHPALQRWYAAIHETQNDREIVGLYAHLVQPVLDAQARREISRFAAESTLMIAVSPLALVDMAFIAWRNLRLINRIATLYGIELGYYSRLRLFRLVLLNIAFAGASELMREVGMDWMSQDLAARLSTRAAQGIGAGLLTARLGIKAMELCRPLPWIDNDKPRLGDFRRQLIGQLKETLQKSKSSPEK

SEQ ID NO: 14726 - DNA, 1131 bp, Mannheimia succiniciproducens MBEL55E
  CDS (1)..(1131): transl_table=11
atgaagaaaagcaaaatgaacgacaaaattatttttaatcaatcggaaaatccaaaagattcgaaagaaccgaccgattttgtggcgaaacaggaatttatcgatataactgatgccgatgtgcggcttgacccggaagatttaaccggcgagttctcactagggcaagaaggcgaattgttgactgaaaatttaacggaaagcctaacgcctaaaccaagatggtggaaaaaattgctgattttgaccgcagttttattcttcggggcaaccgttgcgcaatccgttcaatggctgattgatacatggcagcaacagcagtggatctatttcgtttttgctctggtcagtttatttgtggtgattcttggtttttccgcattattccgagaatggcgacggttagccatattgcgccggcatattgatttacagcgacaaagtgaaactttattgcaaaaaagtgcggtgaatttcgagcaagatttgccggcacaggatagtgaaagcggcaagcagctttgtttaaaaattgccgagtctatgaatctggaaccgcaatatccggcattaaatcaatggcagaagcaaattaatgaaagttattcggcgcaggaagtggcgtatttattcagccaaaccctgttaaagccgattgatgccaaagcgattaaattagtgaccaaaagtgccgttgaggcgggtactattgtggcaatcagccctttagcattggtggatatgttttttatcgcgtggcggaatattcggttagtgaatcgcattgccagactttacggtattgaattaggttatgcgagccgtttgcggttaattcgtctggtgcttttaaatgtggcgtttgccggtgccacggagctcgcacaggaaatcggtatggactggctttcgcaagatatcgccgccaagctttcggcacgagcggcacagggtatcggtgttggtttgttaaccgcgcgtttaggtattaaagccatggaattttgtcgcccgctggtatttagcaagcaagaaaaaccgaaattaacggcgattcaccgggaattattaagtacattaaaatcaacggtttttacctcgtctaaaataaaagataaagagaaaatgtaa

SEQ ID NO: 14727 - protein, 376 aa, Mannheimia succiniciproducens MBEL55E
MKKSKMNDKIIFNQSENPKDSKEPTDFVAKQEFIDITDADVRLDPEDLTGEFSLGQEGELLTENLTESLTPKPRWWKKLLILTAVLFFGATVAQSVQWLIDTWQQQQWIYFVFALVSLFVVILGFSALFREWRRLAILRRHIDLQRQSETLLQKSAVNFEQDLPAQDSESGKQLCLKIAESMNLEPQYPALNQWQKQINESYSAQEVAYLFSQTLLKPIDAKAIKLVTKSAVEAGTIVAISPLALVDMFFIAWRNIRLVNRIARLYGIELGYASRLRLIRLVLLNVAFAGATELAQEIGMDWLSQDIAAKLSARAAQGIGVGLLTARLGIKAMEFCRPLVFSKQEKPKLTAIHRELLSTLKSTVFTSSKIKDKEKM

SEQ ID NO: 14728 - DNA, 1065 bp, Haemophilus influenzae 86-028NP
  CDS (1)..(1065): transl_table=11
atggaaaaacaaatttttgaacattcagttaatgtagaggaagaacactatcagcccaagcaagaattccataatatggaagcaaagctagatgaagcgttggatggagagttacttgatgctcaacttgaacaagcattgaaaccaaaatccagttttagaaaaactttattaaaatttaccgcacttttatttggcttggcgacggttgcacaatccatgcagtggatttgggatagctatcaacaacatcaatggatttatcttgcttttgctttagtcagtttgattatcattttattggggattaaagagattattggcgagtggcgacgtttagttcgtttaaaaaaacgtgagcaatggcaacaacaaagtcagcagatttggttagaaagtgcggtaaaaaatggcgatgttttttccgttcataacgcagaaaaaagtaaaattctttgcttagatattgcagaatctttaggtttggaaaatgattctccagcggtaattcaatggcaacaccaattaaatgaagcttattcggcgcaagaaattgctcatttattcagtcgtcatgttttgtcttcttttgatgcacaagctaaaaaattgattagtaaaatggcagctgaatcagctgtgattgtcgcgattagtccacttgctgtagtggatatgttttttatcgcgtggcgcaatcttcgattaatgaataagattgctgaaatttatgggattgaattagggtatttttcacgtattagattgttaagaatggtattggtcaatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactctcacatattcaacaggaattacttagttcggtaaaagatattgttctcggtaaaaataaaatttacaaaaaggagcaaatctga

SEQ ID NO: 14729 - protein, 354 aa, Haemophilus influenzae 86-028NP
MEKQIFEHSVNVEEEHYQPKQEFHNMEAKLDEALDGELLDAQLEQALKPKSSFRKTLLKFTALLFGLATVAQSMQWIWDSYQQHQWIYLAFALVSLIIILLGIKEIIGEWRRLVRLKKREQWQQQSQQIWLESAVKNGDVFSVHNAEKSKILCLDIAESLGLENDSPAVIQWQHQLNEAYSAQEIAHLFSRHVLSSFDAQAKKLISKMAAESAVIVAISPLAVVDMFFIAWRNLRLMNKIAEIYGIELGYFSRIRLLRMVLVNIAFAGATEVAQDIGMDWLSQDVTAKLSTRIAQGIGVGLLTARLGVKAMELCRPLAFQLNEKPKLSHIQQELLSSVKDIVLGKNKIYKKEQI

SEQ ID NO: 14730 - DNA, 1128 bp, Colwellia psychrerythraea 34H
  CDS (1)..(1128): transl_table=11
atgaccactaaagataatgaaaacttacaacagcagcaaattctttttagcgaaagtgattctgtcacagagcaaggtaaaggccagttcaaagacggggaggctggtgctactttcaccgaacaagttgtttttgataacgatacctacctgcctatgtcgcttgatgaaaatggactcgatgaagtaagaaaaactgagcttgacgatgagcaacttcatcaagatattgatgttgtacagggcggtaaacgttcatggttgtggcgaacaataggtactttatttgtcattttactcgcgattgaagcggttgatttttttatcgtaggattcgaacaatcgccaataattactagtctttatgcgttgttattagcttcgttaaccttagtaagcacaaattatctatggcgtgagttcatagggctgaaacaatttaaaaatcgtcaaaaaatgaaacagcaagcaacagagctgttgttaatagattcagaacaattaacggagcattcaaataaacgagggaaagatttttgtgaaaacattagcaataacttaccctgcgatttggtttttgactgccccaaagaacagcaagtttggcatgatgcgttagcagctgattatagctctagtgaattagttcaactgtactcacgagtggtattaagtaaagttgatgaaaaagcattaaacgaagttgcaaaattctctaccgaagcggttgttttaattgcgctaagccccgtcgctttaatagatatgttgattatgttatcgcgtaatttacgtatgataaataaaattgcaggactttacggcttaaaattagggtattggagtcgtattaagttaataaaacaagtctttgttaatatggcttatgctggcgctagcgagttagttgctgattttggcagtgatatgttgggtgctgaattgttaggtaagttatctgcccggtttgcccaaggattgggtgctggaatgctcactgcaagattaggcgctaaaacaatggagctatgcagacctataccttttaaagaaaaaccaaagttaacacaagtccgtaaaaaaattgctcagcaaattaaagctttagtcagcccatcaaaaaaataa

SEQ ID NO: 14731 - protein, 375 aa, Colwellia psychrerythraea 34H
MTTKDNENLQQQQILFSESDSVTEQGKGQFKDGEAGATFTEQVVFDNDTYLPMSLDENGLDEVRKTELDDEQLHQDIDVVQGGKRSWLWRTIGTLFVILLAIEAVDFFIVGFEQSPIITSLYALLLASLTLVSTNYLWREFIGLKQFKNRQKMKQQATELLLIDSEQLTEHSNKRGKDFCENISNNLPCDLVFDCPKEQQVWHDALAADYSSSELVQLYSRVVLSKVDEKALNEVAKFSTEAVVLIALSPVALIDMLIMLSRNLRMINKIAGLYGLKLGYWSRIKLIKQVFVNMAYAGASELVADFGSDMLGAELLGKLSARFAQGLGAGMLTARLGAKTMELCRPIPFKEKPKLTQVRKKIAQQIKALVSPSKK

SEQ ID NO: 14732 - DNA, 1203 bp, Shewanella sp. MR-4
  CDS (1)..(1203): transl_table=11
atgagtttagattcgttaccaccttcaagtgagtcagagacaaacgggctcgataagccaatgtctgaaaatacacttggaagccaaccgctcaaaaaacaacaagtatttgattctgataaggtcaaacttcagtctgcttctgatgagcttaagagtgcccaagcttttgcaccactgacacccttaaaagcggcggatgaagttgtcgatgatgccttagcggctcatccgcaagcattggatgtatcatccattcggccaaaactgcatcaatctcgccgttggtcttggctggcgcgtttatccgtctttgggttattgctactggttttagtgcaaacgggattaggtttgcgagacgcttggttatcaagcccttggttatttagcttttatggcgcagtactcagtttagtcggcagctgggctatggtcggagccttgggcgaataccgtaaattaaaacgcctcaagcaggttgccgatacgcaagagtcgggtgcaaggcttgccctcagtatgcaaatgggcgaggccgatggttttatcaataatatagtgcgccattatcccgatagtcaggggctacagcgactgcgtcagtcgctcaaagatgaacataacgatgctgaaaaagtgctgttatttgaggatttagtgcttactgagcgggatgaactggcgaaaaaaatcgtccgtcgatacgcggccgagtcagccgtgttgcttgccgcgagtccgctagctgcattggatatggccattattctttggcgtaaccaacgcatgctgcgtgatgtcgccgcctgttatgggatagaattaggctattggagccggataaaactcattcgtagcatcattattaacatcatctatgccggtaccagcgagttagtgaccgatttggggacccaactgctgtcggttgagatgacggggaaattatccgcacggcttgctcaaggtttaggtggggggctgctcacagcgcgcttagggtatcaagccatggcgctatgtagacctattcagtttagggaggagcagcgccccaaattatcgaaagttcatcaagagttgttgattgagcttaaacagtttgccggtaagttattgactaaagacggacgagatgcacttaagagccaattagaggctgctgaacttaaaacaggctcaacacccaaagagaaataa

SEQ ID NO: 14733 - protein, 400 aa, Shewanella sp. MR-4
MSLDSLPPSSESETNGLDKPMSENTLGSQPLKKQQVFDSDKVKLQSASDELKSAQAFAPLTPLKAADEVVDDALAAHPQALDVSSIRPKLHQSRRWSWLARLSVFGLLLLVLVQTGLGLRDAWLSSPWLFSFYGAVLSLVGSWAMVGALGEYRKLKRLKQVADTQESGARLALSMQMGEADGFINNIVRHYPDSQGLQRLRQSLKDEHNDAEKVLLFEDLVLTERDELAKKIVRRYAAESAVLLAASPLAALDMAIILWRNQRMLRDVAACYGIELGYWSRIKLIRSIIINIIYAGTSELVTDLGTQLLSVEMTGKLSARLAQGLGGGLLTARLGYQAMALCRPIQFREEQRPKLSKVHQELLIELKQFAGKLLTKDGRDALKSQLEAAELKTGSTPKEK

SEQ ID NO: 14734 - DNA, 1203 bp, Shewanella sp. MR-7
  CDS (1)..(1203): transl_table=11
atgagtttagatttgttaccaccttcaaacgagtcagattcaaaggggaaggatatgaaggtatccgcggatacacttgaatccctatcgctcaaaaaacaacaagtatttgattctgataaggtcaaacttcagtctgcgccagatgaactcaagagtgcccaggcttttgcgccacagacacccttaaaagcggtggatgaggttgtcgatgatgcctttgcggcccatccacaagcattggatgtgtcatccattcggccaaaactgcatcaatctcgccgttggtcttggctggcgcgcttttccgtctttgggttattgctactggttttagtgcaaacgggattaggtttgcgggacgcttggttatcaagcccttggttatttagcttttatggcgcagtactcggtttagtcggcagctgggctatggtcggagccttgggcgaataccgtaaattaaaacgcctcaagcaggttgccgatacgcaagagtcgggcgcaaggcttgctctcagtatgcaaatgggggaggccgatggttttatcaataacatagtgcgccattatcccgatagtcaggggctacagcggctgcgtcagtcgctcaaagatgaacacaacgacgctgaaaaagtgctgttatttgaggacttagtgcttactgagcgggatgaactggcgaaaaaaatcgtccgtcgatacgcggccgagtcggctgtgttgcttgccgcgagtccgcttgcggcgttggatatggctatcattctgtggcgcaatcaacgcatgcttcgggatgtcgctgcctgctatgggattgagttaggctattggagccggattaaactcattcgtagcatcatcattaacatcatctatgcaggtaccagcgagttagtgaccgatttgggcacccaactgctgtcggttgagatgacggggaaattatctgcacggcttgcccaaggcttaggtggggggctgctcacagcgcgcttagggtatcaagccatggcgttgtgtcgaccaattcagtttagggaggagcagcgccctaaattatcgaaagttcatcaagagttgttgattgagcttaaacagtttgccggtaagttattgactaaagacgggcgcgatgcgcttaagagtcaattagaggctgctgagctgaaaacagactcaacacccaaagagaaataa

SEQ ID NO: 14735 - protein, 400 aa, Shewanella sp. MR-7
MSLDLLPPSNESDSKGKDMKVSADTLESLSLKKQQVFDSDKVKLQSAPDELKSAQAFAPQTPLKAVDEVVDDAFAAHPQALDVSSIRPKLHQSRRWSWLARFSVFGLLLLVLVQTGLGLRDAWLSSPWLFSFYGAVLGLVGSWAMVGALGEYRKLKRLKQVADTQESGARLALSMQMGEADGFINNIVRHYPDSQGLQRLRQSLKDEHNDAEKVLLFEDLVLTERDELAKKIVRRYAAESAVLLAASPLAALDMAIILWRNQRMLRDVAACYGIELGYWSRIKLIRSIIINIIYAGTSELVTDLGTQLLSVEMTGKLSARLAQGLGGGLLTARLGYQAMALCRPIQFREEQRPKLSKVHQELLIELKQFAGKLLTKDGRDALKSQLEAAELKTDSTPKEK

SEQ ID NO: 14736 - DNA, 1203 bp, Shewanella sp. ANA-3
  CDS (1)..(1203): transl_table=11
atgagtttagattcgttatcagcttcaagtgagtcagagacaaacgggctcgataagtcagtgtctgaaaatacacttgaaagccaaccgctcaaaaaacaacaagtatttgattctgacaaggtcaaacttcagtctgcttccgatgagcttaagagtgcccaagcctttgcaccacagacacccttaaaagcggtggatgaggttgtcgatgatgccttagcggcccatccgcaagcattggatgtgtcgtccattcggccaacactgcatcaatctcgccgttggtcttggttggcgcgcttttccgtttttgggttattgctactggttttagtgcaaacgggattaggattgcgggacgcttggttagcaagcccttggttatttagcttttatggcgcagtactcggtttagtcggcagctgggctatggtcggagccttgggcgaataccgtaaattaaaacgcctcaagcaggttgccgatacgcaagagtccggcgcaagacttgctctcagtatgcaaatgggggaggccgatggttttatcaataacatagtgcgccattatcccgatagtcaggggctacagcggctgcgtcagtcgctcaaagatgaacacaatgacgccgaaaaagtgctgctatttgaggacttagtgctgactgagcgggatgaactcgcgaaaaaaatcgtccgtcgatacgcggccgagtctgcagtgttgcttgccgcgagtccacttgctgcattggatatggccattattctttggcgcaatcaacgcatgctgcgggatgtcgccgcctgttacgggatagagttaggctattggagccggattaaactcattcgcagcatcatcatgaacatcatctatgccggtaccagcgagttagtgaccgatttgggtacccaattgctgtcggtcgagatgacggggaaattatccgcacggcttgcccagggcttaggcggcggactgctcacggcacgtttaggttatcaagccatggcgctgtgtcgacctattcagtttagggaggagcagcgccccaaattgtccaaagttcatcaagagttgttgattgagcttaaacagtttgccggtaagttattgactaaagacggacgggatgcgcttaagagtcaattagaggcagcggagcttaaaactggctcaacacccaaagagaaataa

SEQ ID NO: 14737 - protein, 400 aa, Shewanella sp. ANA-3
MSLDSLSASSESETNGLDKSVSENTLESQPLKKQQVFDSDKVKLQSASDELKSAQAFAPQTPLKAVDEVVDDALAAHPQALDVSSIRPTLHQSRRWSWLARFSVFGLLLLVLVQTGLGLRDAWLASPWLFSFYGAVLGLVGSWAMVGALGEYRKLKRLKQVADTQESGARLALSMQMGEADGFINNIVRHYPDSQGLQRLRQSLKDEHNDAEKVLLFEDLVLTERDELAKKIVRRYAAESAVLLAASPLAALDMAIILWRNQRMLRDVAACYGIELGYWSRIKLIRSIIMNIIYAGTSELVTDLGTQLLSVEMTGKLSARLAQGLGGGLLTARLGYQAMALCRPIQFREEQRPKLSKVHQELLIELKQFAGKLLTKDGRDALKSQLEAAELKTGSTPKEK

SEQ ID NO: 14738 - DNA, 1062 bp, Haemophilus influenzae R2846
  CDS (1)..(1062): transl_table=11
atggaaaaacaaatttttgaacattcagttaatgtagaggaagaacactatcagcccaagcaagaattccataatatggaagcaaagctagatgaagcgttggacggagagttacttgatgctcaacttggacaagcattgaaaccaaaatccagttttagaaaaactttattaaaatttaccgcacttttatttggcttggcgacggttgcacaatccgtgcagtggatttgggatagctatcaacaacatcaatggatttatcttgcttttgctttagttagtttgattatcattttattggggattaaagagattattggcgagtggcgacgtttagttcgtttaaaaaaacgtgagcaatggcaacaaagtcagcagatttggttagaaagtgcggtaaaaaatggcgatgttttttccgttcataacgcagaaaaaagtaaaattctttgcttagatattgcaaaatctttaggtttggaaaatgattctccagcggtaattcaatggcaacaccaattaaatgaagcttattcggcgcaagaaattgctcatttattcagtcgtcatgttttgtcttcttttgatgcacaagctaaaaaattgattagtaaaatggcagctgaatcagctgtgattgtcgcgattagtccacttgctgtagtggatatgttttttatcgcgtggcgcaatcttcgattgatgaataagattgctgaaatttatgggattgaattagggtatttttcacgtattagattgttaagaatggtattggtcaatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactgtcacatattcaacaggaattacttagttcggtaaaagatattgttctcggtaaaaataaaatttacaaaaaggagcaaatctga

SEQ ID NO: 14739 - protein, 353 aa, Haemophilus influenzae R2846
MEKQIFEHSVNVEEEHYQPKQEFHNMEAKLDEALDGELLDAQLGQALKPKSSFRKTLLKFTALLFGLATVAQSVQWIWDSYQQHQWIYLAFALVSLIIILLGIKEIIGEWRRLVRLKKREQWQQSQQIWLESAVKNGDVFSVHNAEKSKILCLDIAKSLGLENDSPAVIQWQHQLNEAYSAQEIAHLFSRHVLSSFDAQAKKLISKMAAESAVIVAISPLAVVDMFFIAWRNLRLMNKIAEIYGIELGYFSRIRLLRMVLVNIAFAGATEVAQDIGMDWLSQDVTAKLSTRIAQGIGVGLLTARLGVKAMELCRPLAFQLNEKPKLSHIQQELLSSVKDIVLGKNKIYKKEQI

SEQ ID NO: 14740 - DNA, 1029 bp, Roseovarius nubinhibens ISM
  CDS (1)..(1029): transl_table=11
gtgagtgagagaccgacaccggagggcaagccccgcaaaggcccgatcctctttgagctgggcgatgaggcgggaccgggggcgcgccccgatgaggcccccgccgtgcccgaccccgaggcgccgctgcccgaggggcgggcgatgcagaccgtggcgaccctggccgcacgcaagccgtcgcggcttggccgctggttctgggggcttttgggcacgttgctgggggtgatcctgtcggtggcggcgtgggatttcgtcacctcgctgctcgatcggatgccgcttttggggatggcggtcacggcgctattgctggcgtttctcgttgttttgctggcgattgcgctgcgcgagctggcggggtttgcgcggctccggcggatggaccggttgcaccatatggccgagacggcgctggtcgatcaggaccttggcgcggcgcggcaggtggtggcgcggctcgatacgctctatgcggcgcgggaggatctgcgctggtctcgggcgcggctcagcgagcggcagggcgatcagttcgatgcggcggatttgctcgggctggccgaggccgagctcatggcgccgcttgatgcggcggcgcgggccgagatcgaggcggcggcgcggcaggtggcgacggtgacggcgattgtgccgctggcgctggccgatgtggtggcggcgctcaccgccaatatccggatgatccggcggattgccgaggtctatggcgggcgggccgggacgctcggcagttggcgtctgacccgggcggtgatgacccatctggtggccaccggggcggtggcgattggcgatgatctcatcagttcggtggcgggcggcggcgtgttgtccaagctctcgcggcggtttggcgagggcgtggtgaacggggcgctgacggcgcgcgtgggcgtggcggcgatggaagtgtgccgccccctgcccttcacacggctcaagcggccatcggtgacggggctggtgaaacgggcgctgaccgggctgtttggcgggtcttaa

SEQ ID NO: 14741 - protein, 342 aa, Roseovarius nubinhibens ISM
MSERPTPEGKPRKGPILFELGDEAGPGARPDEAPAVPDPEAPLPEGRAMQTVATLAARKPSRLGRWFWGLLGTLLGVILSVAAWDFVTSLLDRMPLLGMAVTALLLAFLVVLLAIALRELAGFARLRRMDRLHHMAETALVDQDLGAARQVVARLDTLYAAREDLRWSRARLSERQGDQFDAADLLGLAEAELMAPLDAAARAEIEAAARQVATVTAIVPLALADVVAALTANIRMIRRIAEVYGGRAGTLGSWRLTRAVMTHLVATGAVAIGDDLISSVAGGGVLSKLSRRFGEGVVNGALTARVGVAAMEVCRPLPFTRLKRPSVTGLVKRALTGLFGGS

SEQ ID NO: 14742 - DNA, 1026 bp, Photobacterium sp. SKA34
  CDS (1)..(1026): transl_table=11
atgagtgagccgttaaagagtaaaattatttttgaagacccaacagttaaccaagaacaactcaatattgcgtcgaaattcgagtttgcccaacaagccgattttttaccggaagcaatagaacaacaagaaactgaaattgaaaaagatcttaagcaagtattagcagctaaacctaaacgccgttatggttttttaaaaggattagtagttgcaggcgcggcaatggtgggatggcagacggtcgaccatgttgtgacagcttatcaaacagcaaattggttatcgcttggctggagtgctttggttgccggtattgccttggctggtattggcgcattaggtaaggagctcttaaagttacggcggttaaaatcacgtcaaacagagcgtgatgaagctcaactcttacttgatagtgatggcataggtaacggcaaagccttctgtacaaaactggcacagcatagtcagattagtagtgataactatggctatgatcgctggatgaattcgttagatgctacgcacaatgatcgcgaagtacttgagctatatgatcgcttagtggtcagtcagcaagataaattagcccgaaaactagtggcaaaatactcgaccgatgccgctgtaatggttgcattaagcccattagcagtggctgatatgttgctggtggcatggcgtaatttacgcttaattgaacaagtttcacgagtttatggtgttgaattaggttactggtctcggattaagctacttaagctggtattggctaatatggcatttgcaggtgcatctgaagtgatcactgatttggggatggatatgctatcaatggacttagcgggacgtatgtctacccgagttgcgcaaggggtgagtattggtttattgacgggaagacttggcttaaaagcgatcagtttagtacgtcctttaccatggttaccgggagagcaacctaaattggctgaaatacgaagcgatctatttaaacagcttggcaccaaagaaaaagattaa

SEQ ID NO: 14743 - protein, 341 aa, Photobacterium sp. SKA34
MSEPLKSKIIFEDPTVNQEQLNIASKFEFAQQADFLPEAIEQQETEIEKDLKQVLAAKPKRRYGFLKGLVVAGAAMVGWQTVDHVVTAYQTANWLSLGWSALVAGIALAGIGALGKELLKLRRLKSRQTERDEAQLLLDSDGIGNGKAFCTKLAQHSQISSDNYGYDRWMNSLDATHNDREVLELYDRLVVSQQDKLARKLVAKYSTDAAVMVALSPLAVADMLLVAWRNLRLIEQVSRVYGVELGYWSRIKLLKLVLANMAFAGASEVITDLGMDMLSMDLAGRMSTRVAQGVSIGLLTGRLGLKAISLVRPLPWLPGEQPKLAEIRSDLFKQLGTKEKD

SEQ ID NO: 14744 - DNA, 1041 bp, Vibrio sp. Ex25
  CDS (1)..(1041): transl_table=11
atgagtgagttgaagcaaaaacaagttttctctgaaaaggcaatggaaaaagagcagcaatcgaatcaaccggagttgacggcgcagcaaacattcggcgaaaaagaaacattcgtacctgttgaacttaaagaagagcgccaggagaccgaacaggaattgcaactcgagcatgtcattcgtccaaaaccgggcagaaaatggcttgcgactggcgcatttgccacctttgctggtttggttggctggcaagcggtggactcggttataaccgcaattcaaacttctgattggctggctttaagctggacggggtttattgctgcgatcgcttcgcttggtttaggggcgatgggtaaagagctttggaaactgcgcaaactacgaaatcattttagtgttcaagaagaagccgaagcacttgttaatagtgagagtgtggggaaagggaaagccttttgcgaaacagtggcagaacaaagtggtgtgatggcagagaacccgggctttgatcgttggcagaacagcattaaccctgctcatagtgatgctgaaatccttgatatgtatgactcgatggttgtgagccaacaagacaaattggcaacgaaagtcgtatcgcagcacgcaaccgagtgtgcggccctagtcgcggtgagccctctggctgccgctgatatgttgctggtggcgtggcgaaatttcaaaatgatcgacaacctctccaaggtatatggggtagagctaggttatgcctctcgcatcaagctactaaaagcggtatttgtcaatatggcggcggctggtgccagtgagctagctattgatgccagtatggacttgatgtcgatggaccttgcaggcaaagtctccgctcgtgcggggcaggggctaggcgttggtattctcactgcacgtttgggcttgaaagcgatgaccttattgcgtccactaccttggtatcctgaccgtcaggttaaattgggcaccatacgcaaggctgtggcggcgaaagttgcatcaattacgattaaaccgtaa

SEQ ID NO: 14745 - protein, 346 aa, Vibrio sp. Ex25
MSELKQKQVFSEKAMEKEQQSNQPELTAQQTFGEKETFVPVELKEERQETEQELQLEHVIRPKPGRKWLATGAFATFAGLVGWQAVDSVITAIQTSDWLALSWTGFIAAIASLGLGAMGKELWKLRKLRNHFSVQEEAEALVNSESVGKGKAFCETVAEQSGVMAENPGFDRWQNSINPAHSDAEILDMYDSMVVSQQDKLATKVVSQHATECAALVAVSPLAAADMLLVAWRNFKMIDNLSKVYGVELGYASRIKLLKAVFVNMAAAGASELAIDASMDLMSMDLAGKVSARAGQGLGVGILTARLGLKAMTLLRPLPWYPDRQVKLGTIRKAVAAKVASITIKP

SEQ ID NO: 14746 - DNA, 1029 bp, Alteromonadales bacterium TW-7
  CDS (1)..(1029): transl_table=11
atgaacgatacacaccaaacatttcaagcgggtaggcgtattaatacccaagcagatgagcaaatagaagctacgcttgctcctgcaaaaatagtggctcaaggtcaaagtgaatacattgaagagcctaatgatgagcttcttgaagatgaaatagacctagagccggtatataaaaagtcaaaatggcaaacgcttaaaggggtgtttgctataagttttttagtattggtgttactagagtttgcatactcgttagtgtttacattccagcaatcagttattttaggcggtgtatatttaacagcggtggtaagcggtgtgttattaattgggcgcatgctttggcgcgaatacagaatgttgcgcagtttaaaacgtaaccagttgcatagagttaaagccgatagacttttaaatagtgagcaagtaggcggcgcactgccttggctcgaaaagttaaataaacatcaacagcttgataacttcgacacctttaaaaaccaagtggctacccatcatagcgataaagaaataatgaccctttacgcaaatagcttactaataacgcaagatacagaagcaaaaaaacttataaaccgttttgcaacagagtcagctttattagttgcacttagcccccttgcgctagtggatatgatggcagtgctttggcgtggtactaagttaattgagcaaataggtaaaatttatggcattggttttggttacgcaagccgcattaagctttaccgtatgcttataaaacaagttatgtttgtgggtagtgcagagcttgtctctgatttagctgctaccgcgctcagtgcagaattgcttggtaagctttcggggcgagcagcacaaggtgttagcgccggtatttttacagcgcgaattggctataaagcaatggagttaagtcgcccattaccaagactcgagcacaagcggagcttgctaaaagagaccgtacaaagtattgcaggtaaaattataaaacgaggaaaaacagagcctacaaaatag

SEQ ID NO: 14747 - protein, 342 aa, Alteromonadales bacterium TW-7
MNDTHQTFQAGRRINTQADEQIEATLAPAKIVAQGQSEYIEEPNDELLEDEIDLEPVYKKSKWQTLKGVFAISFLVLVLLEFAYSLVFTFQQSVILGGVYLTAVVSGVLLIGRMLWREYRMLRSLKRNQLHRVKADRLLNSEQVGGALPWLEKLNKHQQLDNFDTFKNQVATHHSDKEIMTLYANSLLITQDTEAKKLINRFATESALLVALSPLALVDMMAVLWRGTKLIEQIGKIYGIGFGYASRIKLYRMLIKQVMFVGSAELVSDLAATALSAELLGKLSGRAAQGVSAGIFTARIGYKAMELSRPLPRLEHKRSLLKETVQSIAGKIIKRGKTEPTK

SEQ ID NO: 14748 - DNA, 1065 bp, Haemophilus influenzae
  CDS (1)..(1065): transl_table=11
atggaaaaacaaatttttgaacattcagttaatgtagaggaagaacactatcagcccaagcaagaattccataatatggaagcaaagctagatgaagcgttggacggagagttacttgatgctcaacttgaacaagcattgaaaccaaaatccagttttagaaaaactttattaaaatttactgcacttttatttggcttggcgacggttgcgcaatccgtgcagtggatttgggatagctatcaaaaacatcaatggatttatcttgcttttgctttagtcagtttgattatcattttattgggtattaaagagattatttgtgagtggcgacgtttagttcgtttaaaaaaacgtgagcaatggcaacaacaaagtcagcagatttggttagaaagtgcggtaaaaaatggtgatgttttttccgttcataacgcagaaaaaagtaaaattctttgcttagatattgcaaaatctttaggtttggaaaatgattctccaacggtaattcaatggcaacaccaattaaatgaagcttattcggcgcaagaaattgctcatttattcagtcgtcatgttttgtcttcttttgatgcacaagctaaaaaattgattagtaaaatggcagctgaatcagctgtgattgtcgcgattagtccacttgctgtagtggatatgttttttattgcgtggcgcaatcttcgattaatgaataagattgctgaaatttatgggattgaattagggtattttccacgtattagattgttaagaatggtattggtcaatatcgcttttgctggagcaaccgaagtggcacaagatattggaatggattggctttctcaagatgtgacagcaaaattatctacacgtatcgctcaaggaattggtgtgggattactcactgctagattaggcgtgaaagcaatggaactttgtcgtccgttagcatttcaattaaacgaaaaaccaaaactgtcacatattcaacaggaattacttagttcggtaaaagatattgttctcggtaaaaataaaatttacaaaaaggagcaaatctga

SEQ ID NO: 14749 - protein, 354 aa, Haemophilus influenzae
MEKQIFEHSVNVEEEHYQPKQEFHNMEAKLDEALDGELLDAQLEQALKPKSSFRKTLLKFTALLFGLATVAQSVQWIWDSYQKHQWIYLAFALVSLIIILLGIKEIICEWRRLVRLKKREQWQQQSQQIWLESAVKNGDVFSVHNAEKSKILCLDIAKSLGLENDSPTVIQWQHQLNEAYSAQEIAHLFSRHVLSSFDAQAKKLISKMAAESAVIVAISPLAVVDMFFIAWRNLRLMNKIAEIYGIELGYFPRIRLLRMVLVNIAFAGATEVAQDIGMDWLSQDVTAKLSTRIAQGIGVGLLTARLGVKAMELCRPLAFQLNEKPKLSHIQQELLSSVKDIVLGKNKIYKKEQI

SEQ ID NO: 14750 - DNA, 1062 bp, Klebsiella pneumoniae subsp
  CDS (1)..(1062): transl_table=11
atgagcgaaccgttaaaaccgcggattgattttgatgggccgctgcaagcggagaaaattccgccgctgaaaggcgctcgcgccttcgacaccctggaggcggacaacttcgcgccagcgcggctggtgaccggcgaagaggaagagggggcggcggaagcggtggtggagtcggtcctgcgacccaaacgcagcctgtggcggcggatggtcagcgccggactggcgatcttcggcgtcagcgtcgtggcgcaaggcgtgcaatggacggctaacgcctggcagacccaggactggattgcgctgggcggctgcgtcgccggggcgctgatcgtcggggccggcgtcggttcgctggccaccgagtggcgccgtctgtggcgactgcgccagcgcgcccacgaacgcgatgaagcgcgcgatatgctgcacagtcacgcggtcggtaaagcgaaagcgttttgtgagaagctggcgcagcaggccgggctggatcagtcgcatccggcgctgcagcgctggtatgccgcgatccacgaaacgcaaagcgatcgcgaagtggtgagcctttatgcgcagctggtgcagccggtgctcgatgcccaggcgcggcgggaaatcagccgttcggcggcggagtcgacgctgatgattgccgtcagtccgctggcgctggtggatatggcgtttatcgcctggcggaacctgcggctgatcaaccgaatcgccacgttgtacggcattgagctcgggtattacagccgtctgcgactgtttcgcctggtgttgcttaatatcgctttcgctggcgccagcgaactggtgcgcgaggtggggatggactggatgtcgcaggatctggcggcccggctgtcggcgcgcgccgcgcagggcattggcgccggcctgctgacagcccgtctcgggatcaaggcgatggagctgtgccgcccgctgccgtggatcgccgatgataaaccgcgactcggcgattttcgtcgcgagctgattgggcagttgaaagagaccctgcagaaaagcaaaacccgcccggagaagtaa

SEQ ID NO: 14751 - protein, 353 aa, Klebsiella pneumoniae subsp
MSEPLKPRIDFDGPLQAEKIPPLKGARAFDTLEADNFAPARLVTGEEEEGAAEAVVESVLRPKRSLWRRMVSAGLAIFGVSVVAQGVQWTANAWQTQDWIALGGCVAGALIVGAGVGSLATEWRRLWRLRQRAHERDEARDMLHSHAVGKAKAFCEKLAQQAGLDQSHPALQRWYAAIHETQSDREVVSLYAQLVQPVLDAQARREISRSAAESTLMIAVSPLALVDMAFIAWRNLRLINRIATLYGIELGYYSRLRLFRLVLLNIAFAGASELVREVGMDWMSQDLAARLSARAAQGIGAGLLTARLGIKAMELCRPLPWIADDKPRLGDFRRELIGQLKETLQKSKTRPEK

SEQ ID NO: 14752 - DNA, 1080 bp, Agrobacterium tumefaciens
  CDS (1)..(1080): transl_table=11
atgaaggctcccacacaaaacgatccgcagacacgccgcccggcggctttcacgctcgagaccgaggaggcggcacggccgtccgccacacagaaacgcgcgccccgcagcttcgacgccgagatttcgctgacgccggacgaggatgacccgtttctggcgcctgcggatatcgacgccgccgcattaccggtggcgacgccgaagaaaagccgcttctccttcggcaagctggggctcggggcgcttggtgtccttttctcgctcgccttcgggctctgggcggatcagctcatccgcaatctgttttcccgctccgactggctgggttacaccgcaacgatcgcccttatcgtggcgcttttcgcggttctcgcccttgtcggccgcgaggtcttcggcatcatgcggctcaacgccgtgcagtctctcaaggccgacgctgaaacggccagcctcgacaagagcccaaaacccgcgcgcgccatcgtcacccgcctgaatgcagttctctcgcaccgggccgaaacggcaaaagggcgcgcggcgctgaaggaaacggaaaatgacgtcatcgacggtccgcatctgatcgagcttgccgaacgagaattgctcgtgccgctcgacaggcaggcccgtgccctcattctcaactcctccaagcgcgtgtccgtcgtcaccgccgtcagcccgcgcgccgtggtcgatctcgcttatgtgctgttcgaggtgacgcggctggtgcgcgccatggcggagctttatggcggccgcccgggcacgcttggcatgctgaagctcctgcgcgatgtcgtcgcgcatcttgccgtcacaggctcgattgccgtgggtgacggacttgcccagcaggttctcggtcatggcctcgcctcgaaactctccgcccgtctcggcgaaggcgtcatcaacgggctgatgacggcgcgaatcggcattgccgccatggatctttgccgcccgctgccgttcagggcggtaaagcggccaggcatcggtgatttcatgtccgacctcacgcccgatttaagcggcggaaaaaacggtgaaaaagcctga

SEQ ID NO: 14753 - protein, 359 aa, Agrobacterium tumefaciens
MKAPTQNDPQTRRPAAFTLETEEAARPSATQKRAPRSFDAEISLTPDEDDPFLAPADIDAAALPVATPKKSRFSFGKLGLGALGVLFSLAFGLWADQLIRNLFSRSDWLGYTATIALIVALFAVLALVGREVFGIMRLNAVQSLKADAETASLDKSPKPARAIVTRLNAVLSHRAETAKGRAALKETENDVIDGPHLIELAERELLVPLDRQARALILNSSKRVSVVTAVSPRAVVDLAYVLFEVTRLVRAMAELYGGRPGTLGMLKLLRDVVAHLAVTGSIAVGDGLAQQVLGHGLASKLSARLGEGVINGLMTARIGIAAMDLCRPLPFRAVKRPGIGDFMSDLTPDLSGGKNGEKA

SEQ ID NO: 14754 - DNA, 1026 bp, Haemophilus ducreyi
  CDS (1)..(1026): transl_table=11
atgaaaaaacaaattttcaatgaagaaaatgtttcaattgagaaaaagattgaacctaaacaggaatttgatgctacaaaagtgagcgttgaagatgaaacagagcaattaacggcggaactgattattgagaaaggttttacaccttcacgtttttggataagaggattattagcggttttagtgttgtttgggctagccgtgatagcacgaagtgttcaatgcttgatcgatagcgtgcaagcgcatcaatggattgatttagcttttgcaatcgtcttttttatggtcagtttagcggggattggtgcaattattcgcgaatggtattggttagtttatttacgtaaacatcaagatactcaacacataagtaagcaattactgatggatgaattattggtgactagcggtcaagataatgtagttatttgccaccaaattttagcagatttaaaatcattaccgcatattgcagtagctaaacagcgttggcaaagtcaattaaatgaagcctataatgccaaagaagtgctgtatttatttagtgaaaatgtattgaagccacttgatacacaagtaaaacaaatcattgctaaaagtgctactgaaaatgcgattattgtagccgttagcccgttagtaattgtggatatgctgatgattgcgtggcgtaatattgcgttagtaaataagatcagtcgattatatggaatgcgattaggttatctgagccggcttaaattatttaagatggtgcttacaaatatggtatttgcgggcgctactgaaatggcaaccgatgtaggaatggattttttctcacaaaatttgaccgctaaagtttcgcttagggcagcacaaggcattggcgtggggctattgacggcgagattaggcattaaagcgatggaattttgccgtccaattgcttttcaaaaagaagagcgcccaaaaatatcagagattcggcaacagttattgattgcggttaaaaatcgtttttttgctaaaaatgaagcttag

SEQ ID NO: 14755 - protein, 341 aa, Haemophilus ducreyi
MKKQIFNEENVSIEKKIEPKQEFDATKVSVEDETEQLTAELIIEKGFTPSRFWIRGLLAVLVLFGLAVIARSVQCLIDSVQAHQWIDLAFAIVFFMVSLAGIGAIIREWYWLVYLRKHQDTQHISKQLLMDELLVTSGQDNVVICHQILADLKSLPHIAVAKQRWQSQLNEAYNAKEVLYLFSENVLKPLDTQVKQIIAKSATENAIIVAVSPLVIVDMLMIAWRNIALVNKISRLYGMRLGYLSRLKLFKMVLTNMVFAGATEMATDVGMDFFSQNLTAKVSLRAAQGIGVGLLTARLGIKAMEFCRPIAFQKEERPKISEIRQQLLIAVKNRFFAKNEA

SEQ ID NO: 14756 - DNA, 1080 bp, Rhizobium meliloti
  CDS (1)..(1080): transl_table=11
atgagtgatgatttcaacgaccgtcgacgcaggccggccgccttttccgtggaagccgaggaggccatcgaacgcgagatggaacagacgccgcggcgcgcaccggggagttttagcgaaaaggtcgtcatgacgcccgatgccgaggacccgttcatcggcaccaccgcggctgtcgaatcgctcaacctgccggaagcaatgccgcgtcggcgccggctctccttcggcaagatcgccgcgggggcgttcggcatcctcatttcccttgcggtcgggctttggatcgaccggctcgtgcgcgatctcttttcgcgcgccgactggcttggctatggagctgtcgcagtcgtggcgatcggcgtcatcgctttcctgatcgtggtcgcgcgcgaagtcttcggcatgatgcagctgaccgccgtccagacgctgaaggccgatctcgccgcggccgccgcatccggaaagacgcaagccgcgcgcgctgcgaccgccaggctcgttcacctgctcgccggcaatccccggacggccaagggccgtgcccgtttggcggagaccgagggcgacatcatcgatgcaccccatctcatcgaactgacggaacgtgaattgctggcgcctctcgaccgcgaggcgcggcggatcattcttggcgccgcgaagcgggtgtcgatcgtgactgccgtcagtccccgcgctctcgtggacctcggctacgtgatctacgaatccgcgcggatgatccgtgccatggccgaactctatggcggccgcccgggcacgctcggcctgctgcgcctgatgcgcgatgtcatcgcacatctcgccgtcacgggctcgatcgccgtcggcgacagcctgatccagcagatcctcggccacggcctggcatccaagctgtccgcgcgcctcggcgagggcgtgatcaacgggctgatgacggcgcgcatcgggatcgcggcgatggatctctgcaggccgatgccgtttcgcgcgctgaagcgccccagcatcggcgactttctgggcgacctggcgccgggcaccgcacggtccgagggctcagccggctga

SEQ ID NO: 14757 - protein, 359 aa, Rhizobium meliloti
MSDDFNDRRRRPAAFSVEAEEAIEREMEQTPRRAPGSFSEKVVMTPDAEDPFIGTTAAVESLNLPEAMPRRRRLSFGKIAAGAFGILISLAVGLWIDRLVRDLFSRADWLGYGAVAVVAIGVIAFLIVVAREVFGMMQLTAVQTLKADLAAAAASGKTQAARAATARLVHLLAGNPRTAKGRARLAETEGDIIDAPHLIELTERELLAPLDREARRIILGAAKRVSIVTAVSPRALVDLGYVIYESARMIRAMAELYGGRPGTLGLLRLMRDVIAHLAVTGSIAVGDSLIQQILGHGLASKLSARLGEGVINGLMTARIGIAAMDLCRPMPFRALKRPSIGDFLGDLAPGTARSEGSAG

SEQ ID NO: 14758 - DNA, 1206 bp, Shewanella oneidensis
  CDS (1)..(1206): transl_table=11
atgagtgtagagttgttaccacattcaactgagccgcatgccaacggggcagacaagtctgtatccgccgctgcgcgtgtaactcaatcgcttaaaaaacagcaagtatttgatgctgaacaggtcaaacttcagtctgcaacggatgagttaaaaagtgcgcaaatgtttgcgcctcaaaccccgataacggcgattgatgacgttgttgatgaggcgttagcggcccatccgcaagcattggatgtcgaatccattcgccctaaattacatcaatcccgccgttggtcttggttggcgcgcttatcactaatggcattactgttactcacgctagtgcaaacagtccttggtttgcgggatgcatggcttgaaagtccgtggctatttagtttttatggcgctgtgcttgggattgtgggcagctgggccatagtgggtgttattggcgaatatcgaaaactcaaacggcttaaacaagttgctgatacgcaagagacaggagcaaggctagccctgagtatgcaaatgggtgaggccgatggttttatcgataatatcgtgcggcattaccccgatagccaaggattacaacggctgcgccattcgttaaaagatgaacataatgatgccgaaaaagtattgttgtttgaggacttagtgctaacggagcgggacgaactcgcgaaaaaaatcgtgcgtcgatatgcggccgagtctgcggtgttattggcggccagcccgcttgcagtattggatatggcgatcattctttggcgtaatcagcgaatgctgcgtgatgtcgccgcttgttatggtatcgaattgggttactggagccggattaaactcattcgcagcatagtgatcaacattatttatgccggcaccagtgagttagtgacggacttaggcactcaactgctgtcggtcgagatgacgggtaaattatccgcgcggcttgcccaaggattagggggcggtttgttaaccgctcgcctaggatatcaggccatggcactgtgccgtcccatccgtttcaaggatgaacagcggcctaaattgactaaagtccatcaagaattgttgatggaacttaaacaatttgcggggaatttattgactaaagatggacgtgatgcccttaaaactcagttagaaggcactgaagttaacacgagttcgaaagagaagtcacttagctaa

SEQ ID NO: 14759 - protein, 401 aa, Shewanella oneidensis
MSVELLPHSTEPHANGADKSVSAAARVTQSLKKQQVFDAEQVKLQSATDELKSAQMFAPQTPITAIDDVVDEALAAHPQALDVESIRPKLHQSRRWSWLARLSLMALLLLTLVQTVLGLRDAWLESPWLFSFYGAVLGIVGSWAIVGVIGEYRKLKRLKQVADTQETGARLALSMQMGEADGFIDNIVRHYPDSQGLQRLRHSLKDEHNDAEKVLLFEDLVLTERDELAKKIVRRYAAESAVLLAASPLAVLDMAIILWRNQRMLRDVAACYGIELGYWSRIKLIRSIVINIIYAGTSELVTDLGTQLLSVEMTGKLSARLAQGLGGGLLTARLGYQAMALCRPIRFKDEQRPKLTKVHQELLMELKQFAGNLLTKDGRDALKTQLEGTEVNTSSKEKSLS

SEQ ID NO: 14760 - DNA, 1041 bp, Vibrio parahaemolyticus
  CDS (1)..(1041): transl_table=11
atgagcgaactgaagcagaaacaaattttctctgaaaaagcactagagaaagagcagcaatcggattcaccagaattaacggcgcaaaagacattcagtgaaaaagaaacttttgtaccagtaaagatagaagaagatcgaattgaaaccgaacaagaactgcaacttgaacacgtgattcgccctaggccgggcagaaaatggctcgcaaccagtgtgtttgctacttttgccggattggtcgggtggcaggctgtggactcagttgtcactgcggtgcaaacggctgactggctagcattaggttgggtgggtttcattactgctgtggcatcattgggcctaggtgccatcggtaaagaactctggaagctacgtaaattaagaaatcatttcagtattcaagaagaagccgaactgctcgttcacagtgacagtgtgggtaaaggcaaggtgttttgcgaaaaggtggcagaagagagtggtgtattagcagaaaacccaggctttgatcgctggcagaacagcattaatccagcacacagtgatgcggaaatccttgatatgtacgattctatggtcgttagtcaacaagacaagctcgctacaaaagtggtttctcagcacgcgactgagtctgctgcgctagttgcggtaagtccactcgccgccgctgatatgttgctggtggcgtggcgaaacttcaaaatgatcgataacttatccaaagtgtatggcgttgaattaggttatgcttcgcgcatcaagctattgagagcggtattcgtgaatatggcagcggcaggtgcaagtgagttagccattgacgctggtatggatttgatgtcgatggatcttgctggcaaagtatctgctcgtgcagggcaggggcttggcgtggggattcttactgcgcgtttaggattgaaagcgatggccttactgcgtccgcttccttggtatcctgatcgccaagtcaaactcgggactatccgcaaagccgtggtggcgaaagttgcatcaatcacgatgaaaccataa

SEQ ID NO: 14761 - protein, 346 aa, Vibrio parahaemolyticus
MSELKQKQIFSEKALEKEQQSDSPELTAQKTFSEKETFVPVKIEEDRIETEQELQLEHVIRPRPGRKWLATSVFATFAGLVGWQAVDSVVTAVQTADWLALGWVGFITAVASLGLGAIGKELWKLRKLRNHFSIQEEAELLVHSDSVGKGKVFCEKVAEESGVLAENPGFDRWQNSINPAHSDAEILDMYDSMVVSQQDKLATKVVSQHATESAALVAVSPLAAADMLLVAWRNFKMIDNLSKVYGVELGYASRIKLLRAVFVNMAAAGASELAIDAGMDLMSMDLAGKVSARAGQGLGVGILTARLGLKAMALLRPLPWYPDRQVKLGTIRKAVVAKVASITMKP

SEQ ID NO: 14762 - DNA, 1044 bp, Erwinia carotovora subsp
  CDS (1)..(1044): transl_table=11
atgaacgagccactaaaaccacgcgttacgttcgacgatgtttcaccgcaagagccgcaaccacaactacgtgccggattggcatttgacgagcagagcagcacgccattttcccctatcagccgcgaagaagaagtgccggaagaaggtgcggcggaagaggctatcagtgcggcgctacgtccaaaacgcagcctgtggcggcgtatggtgatggcaggcgtcgcattgttcggcatcagcgcgctggcgcagggcgttcagtcgctgcataacgcctgggtgcaacaggattggatcgcgctgggcggtattacggcgggcagcctgattgtggcggcgggcgttggctcactggctgtcgagtggcgacgactctatcgcctgcgagaacgtgcggaagagcgcgatatggcgcgcgatttgctgcacagccacggagtggaacgtgggcgtgagttctgtgaaaaactggcgcggcaggcagggttggatagcggtcatccggctatacagcgctggcaggcttcactccacgaaacgcacaacgatcgcgaagtattggaattgtatgcgcgtctggttcagcccgtactggacacgcaggcgcggcgtgaaattagtcgttctgcggcagaatctaccttgatgatcgccgtcagcccgctagcgctggtcgatatggcatttattgcctggcgtaacctgcggcttattaatcggattgccgcgttatacggcatcgaactcggctatttcagccgcattcgcttgttccgtctggtgttgattaatattgcgtttgccggtgcatcggagctggtgcgggaaattggcatggactggatgtcgcaggatcttgccgcacggctatcgacccgcgccgcacagggcattggcgcaggtctgctgactgcgcgtctgggtatcaaagcgatggaattatgtcgcccgctgccgtggctggatgacaaaccccgcctcggtgatttccgccgcgagctgattggtcaggtaaaagaaacactgcaaaaaggacgttag

SEQ ID NO: 14763 - protein, 347 aa, Erwinia carotovora subsp
MNEPLKPRVTFDDVSPQEPQPQLRAGLAFDEQSSTPFSPISREEEVPEEGAAEEAISAALRPKRSLWRRMVMAGVALFGISALAQGVQSLHNAWVQQDWIALGGITAGSLIVAAGVGSLAVEWRRLYRLRERAEERDMARDLLHSHGVERGREFCEKLARQAGLDSGHPAIQRWQASLHETHNDREVLELYARLVQPVLDTQARREISRSAAESTLMIAVSPLALVDMAFIAWRNLRLINRIAALYGIELGYFSRIRLFRLVLINIAFAGASELVREIGMDWMSQDLAARLSTRAAQGIGAGLLTARLGIKAMELCRPLPWLDDKPRLGDFRRELIGQVKETLQKGR

SEQ ID NO: 14764 - DNA, 1026 bp, Vibrio vulnificus
  CDS (1)..(1026): transl_table=11
atgagcgatctaaaaccaaaacaagtgtttgaagagacgattttctctcagcaagacaaaccagagctcactgcgcagcagcaatttgatcagcagcagacgttcattccaaccacgattgaagagactgaacctgaacttgaagacgctttggagcaggtgatacgtccatcaggccgtcgcaagtggttagcgggagggctgtttgctgctttcgcaggattggtgggttggcaagccgttgatagcgtactcagtgcgatgcaaaatggcgattggcttacgctcggctggtctgggtttatttccgtgcttgccggcttggggcttggggccatgggcaaagaactgtggaagctgcgccaattgagacacctattttccgtgcaggagcaaggggaaaaattgttgcaaagtgacagtgttgggcaaggcaaagcgttttgccagcaagtggcgaaacaaagtggcgttgcagaagagaatcctgcttatgaccgctggaaaaacagcgtcaataccgcacacagtgatgcagaaatcttgcagatgtacgatgcgatggtcgtgactcaacaagacaaacaagcaaccaaggtgatctcgcgctttgcgacagagtctgcggctctggtggctattagcccactcgccatcgcggacatgctgctggtggcttggcgtaacttcaagatgattgacacgctctcaacgatctatggtatcgagcttggctacgcctctcgaattcgtttgctgcgtctggtgttggcaaacatggcggtggcgggcgccagcgagctggtgattgatgcgggtatggatttgatgtcgatggatctcgctggcaagctttccgccagagcagggcaaggggttggtgtggggattttgactgcgagactgggtttgaaagcgatggcattgctaaggccgattccttggcaagccgaaacacaggttaagttatcagcaattcgcaaagaaattgtgtcgaaagtcgcttctatcacgctaaaaccatag

SEQ ID NO: 14765 - protein, 341 aa, Vibrio vulnificus
MSDLKPKQVFEETIFSQQDKPELTAQQQFDQQQTFIPTTIEETEPELEDALEQVIRPSGRRKWLAGGLFAAFAGLVGWQAVDSVLSAMQNGDWLTLGWSGFISVLAGLGLGAMGKELWKLRQLRHLFSVQEQGEKLLQSDSVGQGKAFCQQVAKQSGVAEENPAYDRWKNSVNTAHSDAEILQMYDAMVVTQQDKQATKVISRFATESAALVAISPLAIADMLLVAWRNFKMIDTLSTIYGIELGYASRIRLLRLVLANMAVAGASELVIDAGMDLMSMDLAGKLSARAGQGVGVGILTARLGLKAMALLRPIPWQAETQVKLSAIRKEIVSKVASITLKP

SEQ ID NO: 14766 - DNA, 1047 bp, Photobacterium profundum
  CDS (1)..(1047): transl_table=11
atgagtgaatcttttcaaaataaagcattcaaaacaaaaatcgtatttgatgaagcaaaaccaacagattcagatgcagaattgacggctcaagtgcaattcgcagagagcaatacttttttgccagaagtgaaagctgatgatgatatagaagagcagctttctcatactttggcgagtaaaacgaagaaacgttcgagctggtttaaaggtttattgatcgctggcgcggcgatgacgggttggcaaacggtggattatgttgtttctgcgtatcaaactggcgattggttagcattaggttggagcgttattgttgcaggtattgcgacaatgggaataacagcacttgggcgtgaattatttaaacttcgccgtttaaagcaacgtcagacagagcgtgagcaagcacaagtgttgctcgatgcagacggcattgggcagggtaaagctttttgtatgaagctggctaagctcagtgatatccgtgatgaacatgcaggttatgatcggtgggtgcagtctttagcggctacgcacaacgaccgggaagtactcgaattgtatgaccaaatggtactcagccatcaagaccggttatcacgtcagctggtggctaagtattcgagtgaagctgccgtaatggtcgcaatgagtccgctagcggtggcagacatgttgctggtggcatggcggaacttcaaattgattgagcaagtctctgtcgtctacggggttgagctggggtattggtctcgcattaaattagtcaaattagtactagccaatatggcttttgcaggggcaacggaagttatcgctgatacgggaatggatatgctatcgatggatttagcgggtcgagtgtcaacccgtgttgctcaaggtgtgggtgtaggtttactgacggggcgattggggcttaaagcgattacattaatgcgaccattaccgtggcaacccgatcagcagcccaaactgagtgaaatacgacgtgatttattgctgaagttaacgcataaaaatgaaagctcgaaaaataattaa

SEQ ID NO: 14767 - protein, 348 aa, Photobacterium profundum
MSESFQNKAFKTKIVFDEAKPTDSDAELTAQVQFAESNTFLPEVKADDDIEEQLSHTLASKTKKRSSWFKGLLIAGAAMTGWQTVDYVVSAYQTGDWLALGWSVIVAGIATMGITALGRELFKLRRLKQRQTEREQAQVLLDADGIGQGKAFCMKLAKLSDIRDEHAGYDRWVQSLAATHNDREVLELYDQMVLSHQDRLSRQLVAKYSSEAAVMVAMSPLAVADMLLVAWRNFKLIEQVSVVYGVELGYWSRIKLVKLVLANMAFAGATEVIADTGMDMLSMDLAGRVSTRVAQGVGVGLLTGRLGLKAITLMRPLPWQPDQQPKLSEIRRDLLLKLTHKNESSKNN

SEQ ID NO: 14768 - DNA, 1065 bp, Photorhabdus luminescens subsp
  CDS (1)..(1065): transl_table=11
atgacggagcctttgaagccaagaattgactttgcagaatccttatcggggccacaagagccggtcttaaagcctgcccagatctttaatgaaaaagagacagcgaatttttgtcctgcttcaccagaacttgaggctgaagaacgcgaaggtcaggtagaagggatagttaatgcagcactgaaacctaagcgtagtggctggcgtaaaatggtatatggttctctgatgttattggggctgagtgcggttgctcagtttgtgcagtggatttatcaatcatggcagcaacaggattggagcgcattaggtgtagcggccgccgggagcatgattgtctttgcgggaataggttctcttgtcagtgagtggcatcgtctttatcggctaagagtgaggtctgaggaacgtgatactgcgagagcgttattgcaacatcatggcgtgggtaaagggcgggaattttgcgagaagttggcaagtcaagcgggtatcgaacagcataacccggcgttacagcgctggcgggctgctttacatgatacacataacgatcgtgaagtggtggtgttgtacagtaaatgggttcaacctgttttggattctcaagtcagggctgaaatcagccgctgtgctgcggaatcagcattaatgatagcagttagcccgttggccattgtcgatatggcatttattgcctggcgtaatatccggctaattaatcgtattgcagctctatatggtattgaactgggatatttcagtcgtattcggctcttccgccttgttttgctgaatattgttttttctggtgcttcagaagtggtgcgggaagtgggtatggattggttatcgcaggatatcgctgcgcgcctttctgtcagagctgctcaagggatcggtgtcggtttactgactgcccggttgggtatcaaagcgatggaattatgtaggccattaccttggatagaaggtgataaacctaaattaggagatttccgtcgtcagctaatcactcaacttaagaatatcctgccaaataagtctaagaatatagttaattaa

SEQ ID NO: 14769 - protein, 354 aa, Photorhabdus luminescens subsp
MTEPLKPRIDFAESLSGPQEPVLKPAQIFNEKETANFCPASPELEAEEREGQVEGIVNAALKPKRSGWRKMVYGSLMLLGLSAVAQFVQWIYQSWQQQDWSALGVAAAGSMIVFAGIGSLVSEWHRLYRLRVRSEERDTARALLQHHGVGKGREFCEKLASQAGIEQHNPALQRWRAALHDTHNDREVVVLYSKWVQPVLDSQVRAEISRCAAESALMIAVSPLAIVDMAFIAWRNIRLINRIAALYGIELGYFSRIRLFRLVLLNIVFSGASEVVREVGMDWLSQDIAARLSVRAAQGIGVGLLTARLGIKAMELCRPLPWIEGDKPKLGDFRRQLITQLKNILPNKSKNIVN

SEQ ID NO: 14770 - DNA, 1074 bp, Haemophilus somnus
  CDS (1)..(1074): transl_table=11
atgccaaaaaaggtttttcaacaagaagatgttgagcaaaaaatcacagaaaattttgagcctaaacaagaatttgagcaagacgaattagatatagaaatggactgctctcaatttgaaacaacaatggatcggcaaaatacagatattccttttcagcatatggttagaccaaaagtgacaatgtggcaaaaattgctcatggctacgatctgtttgtttagctgtggcattttggctcaatcggtgcaatggttggttgatagttggcgggataatcaatggattgcttttgtttttgctatggtcagtttatttttggttttgttagggcttggagcaataataaaagaatggcgacgtttagttcaactaaaaaagcgtttgatattacaagaaaaaagccgagaaattcgctcaaaaagtgcggttaatttaactgaggtttcttctgagggcaaagagttgtgtttaaaaattgcctcgcttatgggaattgatgataaatcgccacaactcattgcttggcaagaacaagttcatgaagcttacactgaacaagaaattctgcgtttatttagtcaaaatgtactaataccttttgatcgggtagcgaagaaacttattagcaaaaatgccgttgaaagtgcattgattgtggcagttagccctttagccattgtggacatgttctttatcgcttggcgtaatattcgtttgattaatcaattagcaaaactttatggtattgagttgggctatgttagtcgtctccgtttgttacgtatggtttttgttaatatggcatttgccggtgcggcagacgtcattcaagatctcggtttagaatggttatctcaagatataacagcaaaattatccgcacgagttgctcaagggattggcgtgggcatacttactgcacgcttaggtattaaagcgatggaattttgtcgccctatagccgttgctccagaggagaaattgcgtttaagtcatatccaaacagaattattgggaacattaaagacgactttatttagtgccaataaagtgaaagagaaagtgcggtag

SEQ ID NO: 14771 - protein, 357 aa, Haemophilus somnus
MPKKVFQQEDVEQKITENFEPKQEFEQDELDIEMDCSQFETTMDRQNTDIPFQHMVRPKVTMWQKLLMATICLFSCGILAQSVQWLVDSWRDNQWIAFVFAMVSLFLVLLGLGAIIKEWRRLVQLKKRLILQEKSREIRSKSAVNLTEVSSEGKELCLKIASLMGIDDKSPQLIAWQEQVHEAYTEQEILRLFSQNVLIPFDRVAKKLISKNAVESALIVAVSPLAIVDMFFIAWRNIRLINQLAKLYGIELGYVSRLRLLRMVFVNMAFAGAADVIQDLGLEWLSQDITAKLSARVAQGIGVGILTARLGIKAMEFCRPIAVAPEEKLRLSHIQTELLGTLKTTLFSANKVKEKVR

SEQ ID NO: 14772 - DNA, 1086 bp, Rhizobium loti
  CDS (1)..(1086): transl_table=11
atgaccgcgccccgcaaaccggcggccttccgcatcgagccggaagccgcgccaacacaagagacgccaaaggcgcgccaggccgagctctcgcgcaaacctcgcgggctgaagaccgatgtcgctctggtcataccggcggaagtcgacgtcttcgacgaacccgacatcgtggccgcggaaccgccgccggcggccgcccccaggaaacgctcgctgttcggcagcatcttcttcggcgcgatcggcgtgctggtttcgctggctgtcggcctgtggaccgaccagctgatccgcgatctcttcgcccgagccgaatggctgggctggctggccgccggcatggcggcgatcgccgtattggcgcttgtggtgatcctgattcgggaattcctggcgatcgcccgccttgccgaagtcgaaaaactgcaaaaacgcgcgctcgacgccatcgcgcgcgacgatcccaaggcggcacgatcggtggtcgacgagctttcggctttcgtcgcggccaagccagagaccgcggcgggtcggcgtgccctggccgaactgcgcggcgaaatcatcgacggcggcaatctggtgcgcctggctgaagcggaaatcctcggtcccctcgatgccagggccaaggtgatgattctcgaagccgccaaacgcgtctcgctggtgacggctgtcagcccgcgcgcgctggtcgacgtcgcctatgtcgtattcgaggccggacgcctcattcgccgtctctcggaactctatggcggacgcccgggaacgctgggtttcttccgcctggcgcgcagcgtgctggcgcatctggcagtcaccggctccatcgccgtcggcgacagtttcgtccagcagatcgtcggccacggcctggcggcgcgcctatcggctaagcttggcgaaggcgtcgtcaacggcatgatgacggcgcgcatcggcatcgcggcgatggaaaccgcgcgtcccctgcccttcagcgccgccaaacggccgggcctgggcgatttcctctcggcattgacatcgtttgccgcgaagaaggacaccgaaaccacaggctctggcaaatag

SEQ ID NO: 14773 - protein, 361 aa, Rhizobium loti
MTAPRKPAAFRIEPEAAPTQETPKARQAELSRKPRGLKTDVALVIPAEVDVFDEPDIVAAEPPPAAAPRKRSLFGSIFFGAIGVLVSLAVGLWTDQLIRDLFARAEWLGWLAAGMAAIAVLALVVILIREFLAIARLAEVEKLQKRALDAIARDDPKAARSVVDELSAFVAAKPETAAGRRALAELRGEIIDGGNLVRLAEAEILGPLDARAKVMILEAAKRVSLVTAVSPRALVDVAYVVFEAGRLIRRLSELYGGRPGTLGFFRLARSVLAHLAVTGSIAVGDSFVQQIVGHGLAARLSAKLGEGVVNGMMTARIGIAAMETARPLPFSAAKRPGLGDFLSALTSFAAKKDTETTGSGK

SEQ ID NO: 14774 - DNA, 1077 bp, Pasteurella multocida
  CDS (1)..(1077): transl_table=11
atgaatgaaaaacgtctttttactgaagcacagacggaaaatgaggctgtggattttacccctaaacgcgaatttcatggtgagatgcatattgaaaaagacgagcctgtgatagaggataggtttgttgaacagacttttgagcatattgtgcaaccgcgatctcgctggtggaaaacaggtttggcactgaccgcacttttattttgttttgcagtgattgctcaatcaattcaatggttagtggacacttggcagcaaaaccaatggatttactttgtgttttcattagtgacatgcttggtggtactattaggggtctcatcactgggtaaagagtggctacgcctcgtcaagttgaaaaaaagactttcattacagcaaaaaagccaacaaatattgcgagaaagtgcggtcaatttagggcaagatttttgtgctgaaaaacatcagcagattaaagcattgtgtacagagatggcgcagatgcttaagctctcttcagaagatccaggtttaatacaatggcaaaaccaattgcatgacgcatattcagcgcaagaagtggcgcatttatttagtcagaccgtgttacatccctttgatgtacaaattaaaaaattgatcagcaaaagtgcgctagaggcggcagtgatcgtcgcagtcagcccattagcggtgatcgatatgttttttctgtcttggcgtaacattcgtttggtcaatcaaattgcccaaatttatgggattgagctaggttattggagccgcttacgtttattaaaaatggtactccttaatcttgcttttgcaggtgcgacagaagttgtgcaagatattggtttagactggttgtcacaggatttgaccgcaaaactgtcggcgcgtgcagcccaaggcatcggtgttggcttattaacagcacgtttagggattaaagctatggaattttgccgccctttagcttttcaagctggtgagaaaccgcgtttaaatcatatacaacaggaactcttgggccaattaagaagtacgttttttcgttccaataaaacgaaagtcaaacagcaagtttaa

SEQ ID NO: 14775 - protein, 358 aa, Pasteurella multocida
MNEKRLFTEAQTENEAVDFTPKREFHGEMHIEKDEPVIEDRFVEQTFEHIVQPRSRWWKTGLALTALLFCFAVIAQSIQWLVDTWQQNQWIYFVFSLVTCLVVLLGVSSLGKEWLRLVKLKKRLSLQQKSQQILRESAVNLGQDFCAEKHQQIKALCTEMAQMLKLSSEDPGLIQWQNQLHDAYSAQEVAHLFSQTVLHPFDVQIKKLISKSALEAAVIVAVSPLAVIDMFFLSWRNIRLVNQIAQIYGIELGYWSRLRLLKMVLLNLAFAGATEVVQDIGLDWLSQDLTAKLSARAAQGIGVGLLTARLGIKAMEFCRPLAFQAGEKPRLNHIQQELLGQLRSTFFRSNKTKVKQQV

SEQ ID NO: 14776 - DNA, 1062 bp, Escherichia coli O157
  CDS (1)..(1062): transl_table=11
atgaccgaaccgttaaaaccacgtattgatttcgacggtccgctggaggtcgaacagaatccaaaattcagggcgcagcagacctttgacgaaaatcaggcgcaaaattttgccccggccacgctcgacgaagcgcaggaagaagaggggcaagtcgaagcggtaatggacgcagcgttacgtccgaaacgcagcctgtggcgcaaaatggtgatgggcgggctggctctgtttggcgcaagcgttgtcgggcagggtgtacagtggacaatgaatgcctggcaaactcaggactgggtggcgctgggtggatgtgctgctggggcattgattatcggcgctggcgtaggttctgtggtaacagagtggcggcgcttatggcgcttgcgacagcgcgcccatgaacgcgacgaagcgcgcgatttgttgcacagccacggcacgggcaaaggccgcgcattttgcgaaaaactggcgcagcaggcgggtattgatcagtctcatccagcgctgcaacgctggtatgcctcaatccatgaaacgcagaacgatcgtgaagtggtcagcctgtatgctcatctggtccagccggttttagatgcccaggcgcggcgcgaaatcagccgctcagcagctgaatcaacgttgatgattgcggtcagcccgctggcgctggtggatatggcatttatcgcctggcgcaatctgcgtttgattaatcgcatcgccacgctgtatggcattgaactgggatattacagccgtttgcgcctgttcaagctggtattgctgaatatcgctttcgccggagccagcgaattggtgcgcgaagtgggaatggactggatgtcgcaagatctcgctgctcgtttgtctacccgcgcagctcaggggattggtgcaggacttctgacggcacgactggggattaaagctatggagctttgccgcccgctgccgtggattgacgatgacaaacctcgcctcggggatttccgtcgtcagcttatcggtcaggtgaaagaaacgctgcaaaaaggcaaaacgcccagcgaaaaataa

SEQ ID NO: 14777 - protein, 353 aa, Escherichia coli O157
MTEPLKPRIDFDGPLEVEQNPKFRAQQTFDENQAQNFAPATLDEAQEEEGQVEAVMDAALRPKRSLWRKMVMGGLALFGASVVGQGVQWTMNAWQTQDWVALGGCAAGALIIGAGVGSVVTEWRRLWRLRQRAHERDEARDLLHSHGTGKGRAFCEKLAQQAGIDQSHPALQRWYASIHETQNDREVVSLYAHLVQPVLDAQARREISRSAAESTLMIAVSPLALVDMAFIAWRNLRLINRIATLYGIELGYYSRLRLFKLVLLNIAFAGASELVREVGMDWMSQDLAARLSTRAAQGIGAGLLTARLGIKAMELCRPLPWIDDDKPRLGDFRRQLIGQVKETLQKGKTPSEK

SEQ ID NO: 14778 - DNA, 1062 bp, Salmonella choleraesuis
  CDS (1)..(1062): transl_table=11
atgagcgaaccgttaaaaccgcgtattgattttgcagaaccgctaaaggaggaacctacgtcggccttcaaagcgcagcaaactttcagcgaagcggagtcgcgtacatttgcgcctgcagctatcgatgagcgcccggaagacgaaggcgtggcagaagcggcggtcgatgccgcgctgcgccccaaacgcagtctgtggcgtaaaatggtgatgggagggctggcgctgtttggcgcgagcgtggtcgggcaaggcctacagtggacaatgaatgcctggcaaactcaggactgggtcgctttaggcggctgtgccgcaggcgcgctgatcattggcgctggcgtgggatcggtggtcacggagtggcggcgattatggcgcttgcgccagcgggcgcatgagcgcgatgaggcgcgtgaactgttacatagccatagcgtcgggaaaggtcgcgcattttgcgaaaaactggcgcagcaggcggggattgatcaatcacatccggcattacaacgttggtatgccgctattcacgaaacgcaaaacgacagggaagtcgtcggtttgtatgcgcatctggtacagccggtacttgacgcgcaggcgcgacgtgagattagccgtttcgccgcggaatcgactctgatgatcgccgtcagcccgttagcgttggtggatatggcgtttattgcctggcgtaatttacgcctgattaaccgcatcgcaacgctgtatggcattgaacttggttattacagccgccttcgtctgttccgtctggtgttgctaaatatcgcgttcgcgggggccagtgagctggtgcgtgaggtcggtatggactggatgtctcaggatctggccgcacgcctgtctacgcgcgcggcgcaggggattggcgcaggtctccttaccgctcgactgggaataaaagcgatggagctatgtcgaccattgccgtggatcgataacgataaaccacgtctcggtgattttcgtcgtcagcttatcggtcagctaaaagagacgctgcaaaagagtaagtcgtcgcctgagaaatga

SEQ ID NO: 14779 - protein, 353 aa, Salmonella choleraesuis
MSEPLKPRIDFAEPLKEEPTSAFKAQQTFSEAESRTFAPAAIDERPEDEGVAEAAVDAALRPKRSLWRKMVMGGLALFGASVVGQGLQWTMNAWQTQDWVALGGCAAGALIIGAGVGSVVTEWRRLWRLRQRAHERDEARELLHSHSVGKGRAFCEKLAQQAGIDQSHPALQRWYAAIHETQNDREVVGLYAHLVQPVLDAQARREISRFAAESTLMIAVSPLALVDMAFIAWRNLRLINRIATLYGIELGYYSRLRLFRLVLLNIAFAGASELVREVGMDWMSQDLAARLSTRAAQGIGAGLLTARLGIKAMELCRPLPWIDNDKPRLGDFRRQLIGQLKETLQKSKSSPEK

SEQ ID NO: 14780 - DNA, 1062 bp, Salmonella paratyphi A
  CDS (1)..(1062): transl_table=11
atgagcgaaccgttaaaaccgcgtattgattttgcagaaccgctaaaggaggaacctacgtcggccttcaaagcgcagcaaactttcagcgaagcggagtcgcgtacatttgcgcctgcagctatcgatgagcgcccggaagacgaaggcgtggcagaagcggcggtcgatgccgcgctgcgccccaaacgcagcctgtggcgtaaaatggtgatgggaggactggcgctgtttggcgcgagcgtggtcgggcaaggcgtacagtggacaatgaatgcctggcaaactcaggactgggtcgctttaggcggctgtgccgcaggcgcgctgatcgttggcgctggcgtgggatcggtggtcacggagtggcggcgattatggcgcttgcgccagcgggcgcatgaacgcgatgaagcacgtgaactgttacatagccatagcgtcgggaaaggtcgcgcattttgcgaaaaactggcgcagcaggcggggattgatcaatcacatccggtattacaacgttggtatgccgctattcacgaaacgcaaaacgacagggaaatcgtcgggttgtatgcgaatctggtacagccggtacttgacgcgcaggcgcgacgtgagattagccgtttcgccgcggaatcgactctgatgatcgccgtcagcccgttagcgttggtggatatggcgtttattgcctggcgtaatttacgcctgattaaccgcatcgcaacgctgtatggcattgaacttggttattacagccgccttcgtctgttccgtctggtgttgctgaatatcgcgttcgcgggggccagtgagctggtacgtgaagtcggtatggactggatgtctcaggatctggccgcacgcctgtctacgcgcgcggcgcaggggattggcgcaggccttcttaccgctcgactgggaataaaagcgatggagctatgtcggccattgccgtggatcgacaacgataaaccacgtctcggtgattttcgtcgtcagcttatcggtcagctaaaagagaccctgcaaaagagtaagtcgtcgccggagaaatga

SEQ ID NO: 14781 - protein, 353 aa, Salmonella paratyphi A
MSEPLKPRIDFAEPLKEEPTSAFKAQQTFSEAESRTFAPAAIDERPEDEGVAEAAVDAALRPKRSLWRKMVMGGLALFGASVVGQGVQWTMNAWQTQDWVALGGCAAGALIVGAGVGSVVTEWRRLWRLRQRAHERDEARELLHSHSVGKGRAFCEKLAQQAGIDQSHPVLQRWYAAIHETQNDREIVGLYANLVQPVLDAQARREISRFAAESTLMIAVSPLALVDMAFIAWRNLRLINRIATLYGIELGYYSRLRLFRLVLLNIAFAGASELVREVGMDWMSQDLAARLSTRAAQGIGAGLLTARLGIKAMELCRPLPWIDNDKPRLGDFRRQLIGQLKETLQKSKSSPEK

SEQ ID NO: 14782 - DNA, 1062 bp, Salmonella typhi
  CDS (1)..(1062): transl_table=11
atgagcgaaccgttaaaaccgcgtattgattttgcagaaccgctaaaggaggaacctacatcggccttcaaagcgcagcaaactttcagcgaagcggagtcgcatacatttgcgcctgcggctatcgatgagcgcccggaagacgaaggcgtggcagaagcggcggtcgatgccgcgctgcgccccaaacgcagcctgtggcgtaaaatggtgatgggagggctggcgctgtttggcgcgagcgtggtcgggcaaggcgtacagtggacaatgaatgcctggcaaactcaggactgggtcgctttaggcggctgtgccgcaggcgcgctgatcgttggcgctggcgtgggatcggtggtcacggagtggtggcgattatggcgcttgcgccagcgggcgcatgagcgcgatgaggcgcgtgaactgttacatagccatagcgtcgtgaaaggtcgcgcattttgcgaaaaactggcgcagcaggcggggattgatcaatcacatccggcattacaacgttggtatgccgctattcacgaaacgcaaaacgacagggaaatcgtcggcttgtatgcgcatctggtacagccggtacttgacgcgcaggcgcgacgtgagattagccgtttcgccgcggaatcgactctgatgatcgctgtcagtccgttagcgttggtggatatggcgtttattgcctggcgtaatttacgcctgattaaccgcatcgcaacgctgtatggcattgaacttggttattacagccgccttcgtctgttccgtctggtgttgctgaatatcgcgtttgcgggggccagtgagctggtgcgtgaagtcggtatggactggatgtctcaggatctggccgcacgcctgtctacgcgcgcggcgcaggggattggcgcaggcctccttaccgctcgactgggaataaaagcgatggagctatgtcgaccattgccgtgggccgataacgataaaccacgtctcggtgattttcgtcgtcagcttatcggtcagctaaaagagacgctgcaaaagagtaagtcgtcgcctgagaaatga

SEQ ID NO: 14783 - protein, 353 aa, Salmonella typhi
MSEPLKPRIDFAEPLKEEPTSAFKAQQTFSEAESHTFAPAAIDERPEDEGVAEAAVDAALRPKRSLWRKMVMGGLALFGASVVGQGVQWTMNAWQTQDWVALGGCAAGALIVGAGVGSVVTEWWRLWRLRQRAHERDEARELLHSHSVVKGRAFCEKLAQQAGIDQSHPALQRWYAAIHETQNDREIVGLYAHLVQPVLDAQARREISRFAAESTLMIAVSPLALVDMAFIAWRNLRLINRIATLYGIELGYYSRLRLFRLVLLNIAFAGASELVREVGMDWMSQDLAARLSTRAAQGIGAGLLTARLGIKAMELCRPLPWADNDKPRLGDFRRQLIGQLKETLQKSKSSPEK

SEQ ID NO: 14784 - DNA, 1062 bp, Salmonella typhimurium
  CDS (1)..(1062): transl_table=11
atgagcgaaccgttaaaaccgcgtattgattttgcagaaccgctaaaggaggaacctacgtcggccttcaaagcgcagcaaactttcagcgaagcggagtcgcgtacatttgcgcctgcagctatcgatgagcgcccggaagacgaaggcgcggcagaagcggcggtcgatgccgcgctgcgccccaaacgcagcctgtggcgtaaaatggtgatgggaggactggcgctgtttggcgcgagcgtggtcgggcaaggcgtacagtggacaatgaatgcctggcaaactcaggactgggtcgctttaggcggctgtgccgcaggcgcgctgatcgttggcgctggcgtgggatcggtggtcacggagtggcggcgattatggcgcttgcgccagcgggcgcatgaacgcgatgaagcgcgtgaactgttacatagccatagcgtcgggaaaggtcgcgcattttgcgaaaaactggcgcagcaggcggggattgatcaatcacatccggcattacaacgttggtatgccgctattcacgaaacgcaaaacgacagggaaatcgtcggtttgtatgcgaatctggtacagccggtacttgacgcgcaggcgcgacgtgagattagccgtttcgccgcggaatcgactctgatgatcgccgtcagcccgttagcgttggtggatatggcgtttattgcctggcgtaatttacgcctgattaaccgcatcgcaacgctgtatggcattgaacttggttattacagccgccttcgtctgttccgtctggtgttgctgaatatcgcgtttgcgggagccagtgagctggtgcgtgaagtcggtatggactggatgtctcaggatctggccgcacgcttgtccacgcgtgcggcgcaggggattggcgcaggtctccttaccgctcgactgggaataaaagcgatggagctatgtcgaccattgccgtggatcgataacgataaaccacgtctcggtgattttcgtcgtcagcttatcggtcagctaaaagagacgctgcaaaagagtaagtcgtcgcctgagaaatga

SEQ ID NO: 14785 - protein, 353 aa, Salmonella typhimurium
MSEPLKPRIDFAEPLKEEPTSAFKAQQTFSEAESRTFAPAAIDERPEDEGAAEAAVDAALRPKRSLWRKMVMGGLALFGASVVGQGVQWTMNAWQTQDWVALGGCAAGALIVGAGVGSVVTEWRRLWRLRQRAHERDEARELLHSHSVGKGRAFCEKLAQQAGIDQSHPALQRWYAAIHETQNDREIVGLYANLVQPVLDAQARREISRFAAESTLMIAVSPLALVDMAFIAWRNLRLINRIATLYGIELGYYSRLRLFRLVLLNIAFAGASELVREVGMDWMSQDLAARLSTRAAQGIGAGLLTARLGIKAMELCRPLPWIDNDKPRLGDFRRQLIGQLKETLQKSKSSPEK

SEQ ID NO: 14786 - DNA, 23 bp, Artificial sequence
  primer
atgaccgaaccgttaaaaccacg

SEQ ID NO: 14787 - DNA, 24 bp, Artificial sequence
  primer
ttatttttcgctgggcgttttgcc

SEQ ID NO: 14788 - protein, 357 aa, Artificial sequence
  consensus sequence
  Variant (2)..(11): Xaa in position 2 to 11 is any amino acid
  Variant (12)..(29): Xaa in position 12 to 29 is any or no amino acid
  Variant (31)..(91): Xaa in position 31 to 91 is any amino acid
  Variant (92)..(108): Xaa in position 92 to 108 is any or no amino acid
  Variant (110)..(131): Xaa in position 110 to 131 is any amino acid
  Variant (133)..(135): Xaa in position 133 to 135 is any amino acid
  Variant (137)..(138): Xaa in position 137 to 138 is any amino acid
  Variant (140)..(191): Xaa in position 140 to 191 is any amino acid
  Variant (192)..(206): Xaa in position 192 to 206 is any or no amino acid
  Variant (208)..(210): Xaa in position 208 to 210 is any amino acid
  Variant (212)..(215): Xaa in position 212 to 215 is any amino acid
  Variant (217)..(220): Xaa in position 217 to 220 is any amino acid
  Variant (222)..(223): Xaa in position 222 to 223 is any amino acid
  Variant (225)..(231): Xaa in position 225 to 231 is any amino acid
  Variant (233)..(233): Xaa in position 233 is any amino acid
  Variant (235)..(239): Xaa in position 235 to 239 is any amino acid
  Variant (241)..(241): Xaa in position 241 is any amino acid
  Variant (246)..(247): Xaa in position 246 to 247 is any amino acid
  Variant (250)..(253): Xaa in position 250 to 253 is any amino acid
  Variant (257)..(257): Xaa in position 257 is any amino acid
  Variant (259)..(266): Xaa in position 259 to 266 is any amino acid
  Variant (269)..(270): Xaa in position 269 to 270 is any amino acid
  Variant (274)..(274): Xaa in position 274 is any amino acid
  Variant (277)..(278): Xaa in position 277 to 278 is any amino acid
  Variant (280)..(282): Xaa in position 280 to 282 is any amino acid
  Variant (284)..(285): Xaa in position 284 to 285 is any amino acid
  Variant (287)..(289): Xaa in position 287 to 289 is any amino acid
  Variant (292)..(293): Xaa in position 292 to 293 is any amino acid
  Variant (295)..(299): Xaa in position 295 to 299 is any amino acid
  Variant (301)..(304): Xaa in position 301 to 304 is any amino acid
  Variant (306)..(311): Xaa in position 306 to 311 is any amino acid
  Variant (314)..(314): Xaa in position 314 is any amino acid
  Variant (316)..(317): Xaa in position 316 to 317 is any amino acid
  Variant (320)..(320): Xaa in position 320 is any amino acid
  Variant (322)..(322): Xaa in position 322 is any amino acid
  Variant (324)..(324): Xaa in position 324 is any amino acid
  Variant (331)..(332): Xaa in position 331 to 332 is any amino acid
  Variant (335)..(337): Xaa in position 335 to 337 is any amino acid
  Variant (340)..(345): Xaa in position 340 to 345 is any amino acid
  Variant (346)..(347): Xaa in position 346 to 347 is any or no amino acid
  Variant (349)..(349): Xaa in position 349 is any amino acid
  Variant (351)..(356): Xaa in position 351 to 356 is any amino acid
FXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXWXXXXXXXXXXXXXXXXXXXXXXEXXXLXXLXXXXXXXXXXXXXXXXXXXXXXXXXXXXXXXXXXXXXXXXXXXXXXXXXXXXXXXXXXXXXXXXXXXEXXXLXXXXVXXXXDXXAXXXXXXXAXEXXXXXAXSPLAXXDMXXXXWRNXRXXXXXXXXYGXXLGYXSRXXLXXXVXXNXXXAGXXEXXXXXGXXXXSXXXXXXLSXRXXQGXGXGXLTARLGXXAMXXXRPXXXXXXXXPXLXXXXXXL

SEQ ID NO: 14789 - protein, 37 aa, Artificial sequence
  protein pattern
  Variant (2)..(2): Xaa in position 2 is any amino acid
  Variant (3)..(3): Xaa in position 3 is Asp, Glu or Asn
  Variant (4)..(4): Xaa in position 4 is Ile, Leu, Met or Val
  Variant (5)..(5): Xaa in position 5 is Ala or Thr
  Variant (6)..(6): Xaa in position 6 is Ala or Gly
  Variant (7)..(7): Xaa in position 7 is Lys or Arg
  Variant (8)..(8): Xaa in position 8 is Leu, Met or Val
  Variant (10)..(10): Xaa in position 10 is any amino acid
  Variant (12)..(12): Xaa in position 12 is any or no amino acid
  Variant (14)..(14): Xaa in position 14 is any or no amino acid
  Variant (17)..(17): Xaa in position 17 is Ile, Leu or Val
  Variant (18)..(18): Xaa in position 18 is Gly or Ser
  Variant (19)..(19): Xaa in position 19 is Ala, Gly, Ile or Val
  Variant (21)..(21): Xaa in position 21 is any or no amino acid
  Variant (24)..(24): Xaa in position 24 is Ala or Gly
  Variant (28)..(29): Xaa in position 28 to 29 is any amino acid
  Variant (30)..(30): Xaa in position 30 is Ala or Thr
  Variant (31)..(31): Xaa in position 31 is Ile or Met
  Variant (32)..(32): Xaa in position 32 is Ala, Glu, Ser or Thr
  Variant (33)..(33): Xaa in position 33 is Phe or Leu
  Variant (34)..(34): Xaa in position 34 is any amino acid
  Variant (37)..(37): Xaa in position 37 is Ile or Leu
SXXXXXXXSXRXAXQGXXXGXLTXRLGXXXXXXXRPX

SEQ ID NO: 14790 - protein, 54 aa, Artificial sequence
  protein pattern
  Variant (2)..(2): Xaa in position 2 is any or no amino acid
  Variant (7)..(8): Xaa in position 7 to 8 is Ala, Ile, Leu or Val
  Variant (11)..(12): Xaa in position 11 to 12 is any amino acid
  Variant (13)..(13): Xaa in position 13 is Ile, Leu or Val
  Variant (14)..(14): Xaa in position 14 is any amino acid
  Variant (17)..(17): Xaa in position 17 is Gly or Asn
  Variant (18)..(18): Xaa in position 18 is any amino acid
  Variant (19)..(19): Xaa in position 19 is Lys or Arg
  Variant (20)..(20): Xaa in position 20 is Leu or Met
  Variant (21)..(21): Xaa in position 21 is Ile, Leu, Met or Val
  Variant (22)..(22): Xaa in position 22 is Asp, Glu, Asn or Arg
  Variant (23)..(23): Xaa in position 23 is any amino acid
  Variant (24)..(24): Xaa in position 24 is Ile, Leu or Val
  Variant (25)..(25): Xaa in position 25 is Ala, Gly or Ser
  Variant (26)..(27): Xaa in position 26 to 27 is any amino acid
  Variant (30)..(30): Xaa in position 30 is Ile or Val
  Variant (31)..(31): Xaa in position 31 is Glu or Gly
  Variant (32)..(32): Xaa in position 32 is Phe or Leu
  Variant (35)..(35): Xaa in position 35 is any amino acid
  Variant (36)..(36): Xaa in position 36 is Pro or Ser
  Variant (38)..(38): Xaa in position 38 is Ile or Leu
  Variant (39)..(39): Xaa in position 39 is Lys or Arg
  Variant (41)..(41): Xaa in position 41 is any amino acid
  Variant (42)..(42): Xaa in position 42 is Lys or Arg
  Variant (43)..(43): Xaa in position 43 is any amino acid
  Variant (44)..(44): Xaa in position 44 is Ile, Leu or Val
  Variant (45)..(45): Xaa in position 45 is Phe, Ile, Leu or Val
  Variant (46)..(46): Xaa in position 46 is any amino acid
  Variant (47)..(47): Xaa in position 47 is Asn or Gln
  Variant (48)..(48): Xaa in position 48 is Ile, Leu, Met or Val
  Variant (49)..(50): Xaa in position 49 to 50 is any amino acid
  Variant (51)..(51): Xaa in position 51 is Ala, Ser or Val
  Variant (53)..(54): Xaa in position 53 to 54 is Ala, Ser or Thr
AXSPLAXXDMXXXXWRXXXXXXXXXXXYGXXXGYXXRXXLXXXXXXXXXXXGXX

SEQ ID NO: 14791 - DNA, 2640 bp, Escherichia coli
  CDS (1)..(2640): transl_table=11
atgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagccgctccaaaaacactcgcgcagtggcaggccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggtaaaactggtgggggaatttgctatgccgctcgtgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggccgtatgcaggttttcctttgagtggccgactgggtgtcaaagtcgacaactggcaggcagggcttgagaacgctctggtcagcggacgactgagtgtgctgacccaggggcaagcgggtaagggcaacgcggtgcttaattttggcccaggaaaattaagcatggataacagtcagctgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccatcttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccatcgtctgggtacgtgacgcacagcatccctcctttagcggcgcgctgtcactggacgccgggcaaacgctgttcactggcggcagtgtgttaccgccatcaaccttaaaatttagcgtcgatgggcgcgatcctacctatttcctctttaaaggcgatttacatgctggtgagattggcccggttcgggtaaatggtcgctgggacggtattcgtctgcgcggtaacgcctggtggcctaaacaatcactgaccgtattccagccgctggtgccacccgactggaagatgaacttacgcgatggtgaactgtatgctcaggttgcattttctgctgcgcctgaacaaggattccgcgcgggaggacacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtactgatgaaacaattacgtatgccgcaacatgacccggcgctgttgcggctgaataatctctcatccagcgaactggttagcgccgtcaatccgaaacaattcgccatgtccggggcatttagtggtgcactgccgttatggctgaacaatgaaaaatggattgtgaaagatggctggctggcgaatagcgggccgatgacattgcgactggataaagacactgcggatgcggtggtaaaagacaatatgactgcgggttcagcaattaactggttgcgctatatggaaattagccgttcatcgacaaaaattaatttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggctggagcagaacgcacgtctgccgggaaatgactgtccgcaaggaaaagagtgtgaggaaaaacaataa

SEQ ID NO: 14792 - protein, 879 aa, Escherichia coli
MLGKYKAVLALLLLIILVPLTLLMTLGLWVPTLAGIWLPLGTRIALDESPRITRKGLIIPDLRYLVGDCQLAHITNASLSHPSRWLLNVGTVELDSACLAKLPQTEQSPAAPKTLAQWQAMLPNTWINIDKLIFSPWQEWQGKLSLALTSDIQQLRYQGEKVKFQGQLKGQQLTVSELDVVAFENQPPVKLVGEFAMPLVPDGLPVSGHATATLNLPQEPSLVDAELDWQENSGQLIVLARDNGDPLLDLPWQITRQQLTVSDGRWSWPYAGFPLSGRLGVKVDNWQAGLENALVSGRLSVLTQGQAGKGNAVLNFGPGKLSMDNSQLPLQLTGEAKQADLILYARLPAQLSGSLSDPTLTFEPGALLRSKGRVIDSLDIDEIRWPLAGVKVTQRGVDGRLQAILQAHENELGDFVLHMDGLANDFLPDAGRWQWRYWGKGSFTPMNATWDVAGKGEWHDSTITLTDLSTGFDQLQYGTMTVEKPRLILDKPIVWVRDAQHPSFSGALSLDAGQTLFTGGSVLPPSTLKFSVDGRDPTYFLFKGDLHAGEIGPVRVNGRWDGIRLRGNAWWPKQSLTVFQPLVPPDWKMNLRDGELYAQVAFSAAPEQGFRAGGHGVLKGGSAWMPDNQVNGVDFVLPFRFADGAWHLGTRGPVTLRIAEVINLVTAKNITADLQGRYPWTEEEPLLLTDVSVDVLGGNVLMKQLRMPQHDPALLRLNNLSSSELVSAVNPKQFAMSGAFSGALPLWLNNEKWIVKDGWLANSGPMTLRLDKDTADAVVKDNMTAGSAINWLRYMEISRSSTKINLDNLGLLTMQANITGTSRVDGKSGTVNLNYHHEENIFTLWRSLRFGDNLQAWLEQNARLPGNDCPQGKECEEKQ

SEQ ID NO: 14793 - DNA, 2646 bp, Enterobacter cloacae
  CDS (1)..(2646): transl_table=11
ctgcccatgaagggtaaatacaaagccgcaatcgcgctattactgctgctattactcgtgccgctgacgctgctgatgacgctcgcccagtgggtacccacgctcgccgggatctggctccctgttggaacgcgcatcgcgtttgaagaaagcccacggctcacgcgccacgccctgatcatccccgatctccgctatctggtagaagagtgcgaaattgcccgtgtggaaaacgtgaccctgtcacaccccagccgttgggatcttgatattggcgcacttgaacttaactctgtctgcctgagcaaattaccgcagtcagcgtcctcaacggtggcgccgaaaacgctggcgcagtggcaggccatcctgcccaacacctggctgaccatccaccgctttaccctttctccctggcagcagtgggagggtgagctgcatgcttcactcacgccagcccgccaggacatcacttataacggcgagcaggtgagcattaaggggcagttgcgcggccagacgctctccatcagccagttcgatgtgcaactgccggatcagccgcagcccgtgaagctgatcggtgaatttaccctgccgttggtaccggacggcgtgccggtgaaagggcatacggtcgcgacctttaacgtgccacagttatcctcgctggtcgatgccgatctggactgggaggacaatcagggccagctggtggtcatggcgcgggacaaccccgatccactgctcgatttaccgtggcagatcaccgctcagcagttaaccatcagcgacggacgctggaactggtcagcctccggtatgccgatgagcggtcgcgtcgggctgaaagtggataactggcagcaggggctggagaaagccaccttcacggggcggctcaacgtgctgacccagggtgatgcggggaagggcaacgcggtgctgaatattggtcccggctcgctcagtatggaaaacagcgctatgccgctgcacctgagcggggaagccaagcaaaacgatctgatcctgtatgccagactcccggcgaagctgaccggcagcctttacgatccgcagcttacgtttgaacccggcgcattattgcgctcgcgcgggcgcatcatcgactcgctggatatcgatgagatccgctggccgctggcaggcgtgaagctcacgcagaagggcgtggacggccgcctgcaagccattctgcgggcgcatgaaaacgagatgggcaattttgagctgcatctggacggccaggctaacgactttttaccggacaacggtttgtggcagtggcgctactggggtaaagggaatttcacgccgatgaatgcgcgctgggatgtccggggaaccggggagtggcgcgacaacgttatcgaactgaccgatctttccacggggttcgacaaattgcagtacggtacgatgctggtcagcaagccgcgcctggtgctggatcacccggtgcgctggtcgcgggacccggataaccccacctttagcggcgcgctcgcgctcaatgccgggcaaacaagcttctcgggcggaagcgtgctgccgccgtccgttttgaccttcagcgttgacgggacagacccgacggtgttccagtttaaagggaacctgcatgcggacgacatcggcccggtccaggtgaatggacgctgggatggcgaacgccttcgcggtaaggcctggtggccaaaacagtctcttacggtgttccagccgttgatcccgccagactggaaaatgaccctgcgcggcggcgaaatgtacgcacaggtggctttctcagcggcctccgatcaggggtttgaggccggggggcacggggtgctgaaagcgggcagcgcgtggatgccggataacgaaatcaacggcgctgattttgttctgccgttccgcttaagccaggatacctggtcgctgggcacgcgcgggccggtaacgttacgaatcgacgaggtaaaaaacctggtcacagcccgaaatatcaccgcggatctccagggcgattatccctggaccgaagcgaacccgctcctgctcaccaacgtgaaggtggaagcgctcggcgggaaaatcaccatgcagcagttgagaatgccgcagcacgatccggctttactacgcgtggataatatttcctccagcgaactgataagcgcggtgaatccgaagcagtttgccatgtccggcccggtgagcggcgcgctgccgttctggctggacaatgaaaaatggatcattaaagatggctggctgaccaacccggggccgatgacgctgcgcatcgaccaggacacggcggatgccattgtgaaagacaacgtggttgccggggcggcgatcaactggctccgctatatggaaatttcgcagtcgtggacaaaactcaatgtggataatctgggtgtgttaaccatgcaggcggccattaaaggcaccagccgcgtcgagggcaaaagcagtttcgtaaacctgaattacacccatgaagagaacatttttaccctctggcgcagcctgcgctttggggacaatctgcaaacatggtttgagcaacatgcggcgataccccttctccgcggttcgacaggcaaggaaagtgaggaacaacaatga

SEQ ID NO: 14794 - protein, 881 aa, Enterobacter cloacae
LPMKGKYKAAIALLLLLLLVPLTLLMTLAQWVPTLAGIWLPVGTRIAFEESPRLTRHALIIPDLRYLVEECEIARVENVTLSHPSRWDLDIGALELNSVCLSKLPQSASSTVAPKTLAQWQAILPNTWLTIHRFTLSPWQQWEGELHASLTPARQDITYNGEQVSIKGQLRGQTLSISQFDVQLPDQPQPVKLIGEFTLPLVPDGVPVKGHTVATFNVPQLSSLVDADLDWEDNQGQLVVMARDNPDPLLDLPWQITAQQLTISDGRWNWSASGMPMSGRVGLKVDNWQQGLEKATFTGRLNVLTQGDAGKGNAVLNIGPGSLSMENSAMPLHLSGEAKQNDLILYARLPAKLTGSLYDPQLTFEPGALLRSRGRIIDSLDIDEIRWPLAGVKLTQKGVDGRLQAILRAHENEMGNFELHLDGQANDFLPDNGLWQWRYWGKGNFTPMNARWDVRGTGEWRDNVIELTDLSTGFDKLQYGTMLVSKPRLVLDHPVRWSRDPDNPTFSGALALNAGQTSFSGGSVLPPSVLTFSVDGTDPTVFQFKGNLHADDIGPVQVNGRWDGERLRGKAWWPKQSLTVFQPLIPPDWKMTLRGGEMYAQVAFSAASDQGFEAGGHGVLKAGSAWMPDNEINGADFVLPFRLSQDTWSLGTRGPVTLRIDEVKNLVTARNITADLQGDYPWTEANPLLLTNVKVEALGGKITMQQLRMPQHDPALLRVDNISSSELISAVNPKQFAMSGPVSGALPFWLDNEKWIIKDGWLTNPGPMTLRIDQDTADAIVKDNVVAGAAINWLRYMEISQSWTKLNVDNLGVLTMQAAIKGTSRVEGKSSFVNLNYTHEENIFTLWRSLRFGDNLQTWFEQHAAIPLLRGSTGKESEEQQ

SEQ ID NO: 14795 - DNA, 2640 bp, Escherichia coli O157:H7 EDL933
  CDS (1)..(2640): transl_table=11
  misc_feature (2222)..(2222): r is g or a
atgctgggtaaatataaagccgttctcgcgctgttattactgattattcttgtgccgttgacgctgctgatgacgctcgggctgtgggttcccacgctggcgggcatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagctgctccaaaaaccctcgcgcaatggcagtccatgctgcctaacacctggatcaatattgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgtcggttaaactggtgggggaatttactatgccgctcatgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggccgtatgcaggttttcctttgagtggccgactgggtgtcaaagtcgacaactggcaggcagggcttgagaacgctctggtcagcggacgactgagtgtgctgacccaggggcaagcgggtaagggcaacgcggtgcttaattttggcccaggaaaattaagcatggataacagccagctgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccattttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccgtcgtctgggtacgtgacgcacagcatccctccttcagcggcgcgctgtcactggacgccgggcaaacgctgttcactggcggcagtgtgttaccgccatcaaccttaaaatttagcgtcgatgggcgcgatccgacgtatttcctctttaaaggcgatttacatgctggtgagattggcccggttcgggtaaatggtcgctgggacggtattcgtctgcgcggtaacgcctggtggcctaaacaatcactgactgtattccagccgctggtgccacccgactggaagatgaacttacgcgatggtgaactgtatgctcaggttgcattttctgctgcgcctgaacaaggattccgcgcgggagggcacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaaccattgctgttgactgatgttagcgtcgatgtgttaggcggtaacgtgctgatgaaacaattacgtatgccgcaacatgacccggcgctgttgcggctgaataatctctcatccagcgaactggttagcgcggttaatccgaaacagtttgctatgtctggggcatttartggggcgttgccactatggctgaacaatgaaaaatggattgtcaaagatggctggttggcaaacgcggggccgatgacgctgcgtctggataaagacactgcagatgcggtggccaaagacaatatgaccgctggaactgccatcaactggttgcgttatatggaaatcagtcgctcatcaacaaggattaatttagataatctcggtgtgttaaccatgcaggccaacatttcgggcaccagtcgcgtcgatggtaaaagcggtacggtaaaccttaattatcaccatgaagagaatatttttacgttatggcgcagtttacgctttggcgataatctccaggtatggctggagcagaatgcccagctaccggaaactggctgcccatcaggaaaagagtgtgaggaaaaacaatga

SEQ ID NO: 14796 - protein, 879 aa, Escherichia coli O157:H7 EDL933
  misc_feature (741)..(741): The Xaa at location 741 stands for Asn, or Ser.
MLGKYKAVLALLLLIILVPLTLLMTLGLWVPTLAGIWLPLGTRIALDESPRITRKGLIIPDLRYLVGDCQLAHITNASLSHPSRWLLNVGTVELDSACLAKLPQTEQSPAAPKTLAQWQSMLPNTWINIDKLIFSPWQEWQGKLSLALTSDIQQLRYQGEKVKFQGQLKGQQLTVSELDVVAFENQPSVKLVGEFTMPLMPDGLPVSGHATATLNLPQEPSLVDAELDWQENSGQLIVLARDNGDPLLDLPWQITRQQLTVSDGRWSWPYAGFPLSGRLGVKVDNWQAGLENALVSGRLSVLTQGQAGKGNAVLNFGPGKLSMDNSQLPLQLTGEAKQADLILYARLPAQLSGSLSDPTLTFEPGALLRSKGRVIDSLDIDEIRWPLAGVKVTQRGVDGRLQAILQAHENELGDFVLHMDGLANDFLPDAGRWQWRYWGKGSFTPMNATWDVAGKGEWHDSTITLTDLSTGFDQLQYGTMTVEKPRLILDKPVVWVRDAQHPSFSGALSLDAGQTLFTGGSVLPPSTLKFSVDGRDPTYFLFKGDLHAGEIGPVRVNGRWDGIRLRGNAWWPKQSLTVFQPLVPPDWKMNLRDGELYAQVAFSAAPEQGFRAGGHGVLKGGSAWMPDNQVNGVDFVLPFRFADGAWHLGTRGPVTLRIAEVINLVTAKNITADLQGRYPWTEEEPLLLTDVSVDVLGGNVLMKQLRMPQHDPALLRLNNLSSSELVSAVNPKQFAMSGAFXGALPLWLNNEKWIVKDGWLANAGPMTLRLDKDTADAVAKDNMTAGTAINWLRYMEISRSSTRINLDNLGVLTMQANISGTSRVDGKSGTVNLNYHHEENIFTLWRSLRFGDNLQVWLEQNAQLPETGCPSGKECEEKQ

SEQ ID NO: 14797 - DNA, 2697 bp, Yersinia pestis CO92
  CDS (1)..(2697): transl_table=11
atggctaaatgcgcaaaaatagtagtcgggttgttattaataagcgcactgtcgctgctcgtgttatggaaaactctgccgacatggttaccgagagtcgccgggtattggttacctgcgggtagccaactgcaattacccgttcttcctgtgtggcgtaatggcgagttgcgtgtcgagcaactgcgttatttggctcaggattgtacgctcgctaatatcagtcaactgagtataggttatcaccaaggacgctggcagttgggtgcgggtgatgtggtgctggagactgcttgtttgagtcagttaccgtctggcggtgatagctctccgctcgatttggcgcaatggcagcagcaactgtcccgttttgatcttactatcaatcatctgctggtcaccccttggcagcaatatgcaggcaagctgacactgacatcacctgacaacaataaatctcttcagacactcggttatcaggggcagcaactcagctttgctgtgacgttgaatgaacaacagcagcttagtttgaatcagttctctatggccattcccggtatgcctcaactgtttcagcttagcggtaaaattaaaatcccgttgtcattggatgagtggccagagcaaggcgcattagatgggctattgaccaccggttatttgtcgaagccgctgctattgaacttgagttggcagcaacagcagggcgtattgaccttaactgagcgtggcgataaccaacctttagcgcgtttaccctggcaagcctcggcgaatcttattcagatcgtgaacggtcagtggcaatggccatatggtcaacagccgttgaaggggggcgttaacctgacactacacgattgggatcaaggattggaacagacctcgattgatgcacggattaacgtgattacctcggggaaaaatggcaaagggaacgccgtattgacgctggggccgggcaatttgggtttaattaacagtgagttaaaattccaactaagtgggcaagtaaatctggaaaccatggtgtttaacgccacgatccccggtttacttagcggttcagtattgaatccgacgtggatattgtcccccggcgccttgctgcgtacttatggtaatctgaccccggaattgcggataaaagatgctcgttggccgctggcgggtatccgggtgaccgccgcgggtgttacggggcgtttacaggcaatcgttgatgctcaggatagctactgggggagtgtcaatctgcatttggatgggcaggcacaagcgttttggccagataagggcaattggcaatggcgctattgggggagcggaaacttgccaccattagcggcacgctgggatgtgggggggacggggagttggcgggatacgctgattacggtggatacgctgtcaacggggtttgatcgtttacaatatggcctagtcaaggtggacgcaccacgtttgatattgacgaaaccgctgacctggcaacgagataaccaccaccccgcgtttattgcaggtctgaaactgagcgctaaaaaagtggagttcagtgatggtggcggttatctccccccgtcagtgttatcactgcaattcaatggccgcgatctcgatagtttcctctggcaagggcaattgcaagctcagtctatcgggccaattccgctacgtggccgctgggatggtgagcgcttgcgtggtgagggttggtggcctaagcagtcattaatggtcttccagccactgatttcaaaagatctggggatcaaactgcgggacggtacgttttatgcgcaagccgcattctctgcggcgcgtgaacaagggtttactgccggtgggcattgggtggtaaacaatggcggcatgtggctgcaggacggtgagttaagcgggctagattttgtcatgtcgtatcgtttacagaaccatcactggcagttaggggctaaagagccggtaatgctacgtatcgcttcgttgaataacctctttgatatgcagaatattactgctgatttacaggggacttatccttattcagaaacggcaccactaacattaagcaatgttggcatggatattttgaacggccacctgagcttgtctgcgctgcgtttgccacaacatgatgccgccgtcctcaaattaagtcagattgatctgagcgcgttgttcaccgtattacaaccgaagcaatttgcgatgtcgggtaaagtgaacggcgaattaccgctttatcttaataacccacagtggctggtgcgtaatggttggattgccaatgacggcatgctgacattacggctcgataaagacctgaccgattctatcagtgagagcaatactgtcgccggtgcggcgattgactggttgcgttacatggagatttctcaatcgtataccaaagtggatctggataatctggggcagttgacgctaacctctaaagttcatggtgtgaattcgcaaaaaaatagcacacgggcggtagtactgaattaccagcaccaggagaacctgttccaactttggcgcagcctacgatttggtgacaatttacaagagtggttgcaacagactatttcattaccatcagcgagttcattaccgtccgcgagttcattaccgcaaggtatttcatcacaaccaacagcaccaataccgacgagggcgaaggaatga

SEQ ID NO: 14798 - protein, 898 aa, Yersinia pestis CO92
MAKCAKIVVGLLLISALSLLVLWKTLPTWLPRVAGYWLPAGSQLQLPVLPVWRNGELRVEQLRYLAQDCTLANISQLSIGYHQGRWQLGAGDVVLETACLSQLPSGGDSSPLDLAQWQQQLSRFDLTINHLLVTPWQQYAGKLTLTSPDNNKSLQTLGYQGQQLSFAVTLNEQQQLSLNQFSMAIPGMPQLFQLSGKIKIPLSLDEWPEQGALDGLLTTGYLSKPLLLNLSWQQQQGVLTLTERGDNQPLARLPWQASANLIQIVNGQWQWPYGQQPLKGGVNLTLHDWDQGLEQTSIDARINVITSGKNGKGNAVLTLGPGNLGLINSELKFQLSGQVNLETMVFNATIPGLLSGSVLNPTWILSPGALLRTYGNLTPELRIKDARWPLAGIRVTAAGVTGRLQAIVDAQDSYWGSVNLHLDGQAQAFWPDKGNWQWRYWGSGNLPPLAARWDVGGTGSWRDTLITVDTLSTGFDRLQYGLVKVDAPRLILTKPLTWQRDNHHPAFIAGLKLSAKKVEFSDGGGYLPPSVLSLQFNGRDLDSFLWQGQLQAQSIGPIPLRGRWDGERLRGEGWWPKQSLMVFQPLISKDLGIKLRDGTFYAQAAFSAAREQGFTAGGHWVVNNGGMWLQDGELSGLDFVMSYRLQNHHWQLGAKEPVMLRIASLNNLFDMQNITADLQGTYPYSETAPLTLSNVGMDILNGHLSLSALRLPQHDAAVLKLSQIDLSALFTVLQPKQFAMSGKVNGELPLYLNNPQWLVRNGWIANDGMLTLRLDKDLTDSISESNTVAGAAIDWLRYMEISQSYTKVDLDNLGQLTLTSKVHGVNSQKNSTRAVVLNYQHQENLFQLWRSLRFGDNLQEWLQQTISLPSASSLPSASSLPQGISSQPTAPIPTRAKE

SEQ ID NO: 14799 - DNA, 2637 bp, Salmonella enterica subsp. enterica serovar Typhi str. CT18
  CDS (1)..(2637): transl_table=11
atgaagggtaaatataaagccgcccttgcgctactgttactgctgattcttgtccctctgacgctactgatgaccctcgggctgtgggttcccactctggcgggaatttggctacccgtcggtacccgtatcgctctggaacaaagtccacgcctgacacgtcatgggttagtgattcccgatcttcgctatctggtcaatgattgttcgttagcgcatattacccaggcggaactgacgcatcccagccgttggttgctgaatattaaaagcctcaaactggatgccgcatgcctggcgaaactgccggcttcggaagcttctcccgccgcgccgcgtacgctggcgcagtggcagtcaatgctgcccaatacctggattaacatcgataatgtcattctcgcgccctggccggaatggcagggcaagctggcgatctccatgacgccggtcattcagcagatacgttatcagggcgaaaaagtaaaatttcaagggcagctacgcggtcaggcattgacggtgagccaactggagatcgccgcgctggccaaccagcctcccgttagcctggcgggggagtttatgttgccgctggtaccggatggcctgccggtcagcggtcatgcggcagcgaccttgcgtctgccgcaggaaccgtcgctggtggatgcggaactggagtggcgtgataatgccggacagctcatcgtgatggcgcgaggtaatcctgatccgattctcgatctcccctgggcggtaacgcgtcagcggcttaccgtcagcgatggccgctggaactggccatatcagggattccccttgagcggacgtctggcttttaatatcgataactggcaagccgggccggataatgcgcgagtcagcggacgcctgaatattctgacccagggcgatgccggtaaagcgaacgcggtactgactatcggcccgggaaaactcagcatggatagcagtgagatgcctctacagcttaccggcgaggctaaacagaaggatttaatcttttatgccgtattgcccgctatgttccgcggcagtctggccgatccgcagctcacctttgcacctggcgcattgctacgctcacgcggacgggtgattgatgcgttagatattgatgaaattcgttggccgctggcgggcgttaaggtaacgccgcgcggcgttgatggtcgattacaggctattttacgggcgcacgaaaatgagatgggcgatttcgttcttcatcttgatggcctggccaatgattttctccctgatgctggtcgctggcggtggcgctattgggggcaaggaagctttacgccaatgcgcgcccgctgggatattgccggacagggcgaatggcatgataacaccatcaggttgaccagtttgtccaccggttttgatcagttgcactatggcgcaatgaccgtcacatcgccaagactggcgctggataaacctattgtctgggttcgcgacgccacaacgccgtcgctacagggcgcgctgtctctggaggcgggaaaaaccgtatttaccagcgggagcgtgctgccgccttctacccttaattttagcgttgaagggcgcgagccaaccctgttccagtttaaaggcgaccttcgggcgggggcgatagggccggtacggctgaacgggcgctgggatggcgaacgccttcgcggacaggcctggtggccgaagcagtcgcttatcgttttccagccgttgcttccaccggactggaaaatgacgctgcgcgaaggctcactgtatgcgcaggtggctttttccgctgcgcaggggcagggatttgaagcaggtggacacggcgtgttaaagggcggtagcgcctggatgccggataacaaaatcaacggcgtcgatttcattctgccatttcgcttccacaacggcgcgtggcaattggggacgcgcgggcccgtctcgctgcgtattgccgggatagtcaaccaggtcacggcgaaaaatatcaccgccgatttacagggcggttatccctggagcgagtcgaatccattactgctaagcgatgtcagcgtagacgtgctgggcggtcaaattattatgaaacagttgcgaatgccgcagcacgacccggcgcttttgcgggtgcaaaatatttcatccagcgaattgattagcgccataaatccaaagcaattcgccatgtctggtccggttagcggcgcgctgccgctgtggctgaacaatgaaaaatggataatcaaagatggctggcttacgaatcctgggccaatgacgttgcgtatcgataaagatactgcggatgcggtggtgaaggataatgtcacggcaggctcggcgattaactggctacgttatatggagattacgcattcgtggacaaaaattaacgttgataacctgggcgtactaacgatgcaggcggccattaccggcaaaagccgggtagatggtaaaaccgcgatcgttaacttgaactatacccatgaagaaaatgtgtttacgctgtggcgcagtttgcgttttggcgacaatttacaggcatggcttgaacaaaatacagcgttgccgcaacctccttgccggaaagacaaggactgtgaggataaataa

SEQ ID NO: 14800 - protein, 878 aa, Salmonella enterica subsp. enterica serovar Typhi str. CT18
MKGKYKAALALLLLLILVPLTLLMTLGLWVPTLAGIWLPVGTRIALEQSPRLTRHGLVIPDLRYLVNDCSLAHITQAELTHPSRWLLNIKSLKLDAACLAKLPASEASPAAPRTLAQWQSMLPNTWINIDNVILAPWPEWQGKLAISMTPVIQQIRYQGEKVKFQGQLRGQALTVSQLEIAALANQPPVSLAGEFMLPLVPDGLPVSGHAAATLRLPQEPSLVDAELEWRDNAGQLIVMARGNPDPILDLPWAVTRQRLTVSDGRWNWPYQGFPLSGRLAFNIDNWQAGPDNARVSGRLNILTQGDAGKANAVLTIGPGKLSMDSSEMPLQLTGEAKQKDLIFYAVLPAMFRGSLADPQLTFAPGALLRSRGRVIDALDIDEIRWPLAGVKVTPRGVDGRLQAILRAHENEMGDFVLHLDGLANDFLPDAGRWRWRYWGQGSFTPMRARWDIAGQGEWHDNTIRLTSLSTGFDQLHYGAMTVTSPRLALDKPIVWVRDATTPSLQGALSLEAGKTVFTSGSVLPPSTLNFSVEGREPTLFQFKGDLRAGAIGPVRLNGRWDGERLRGQAWWPKQSLIVFQPLLPPDWKMTLREGSLYAQVAFSAAQGQGFEAGGHGVLKGGSAWMPDNKINGVDFILPFRFHNGAWQLGTRGPVSLRIAGIVNQVTAKNITADLQGGYPWSESNPLLLSDVSVDVLGGQIIMKQLRMPQHDPALLRVQNISSSELISAINPKQFAMSGPVSGALPLWLNNEKWIIKDGWLTNPGPMTLRIDKDTADAVVKDNVTAGSAINWLRYMEITHSWTKINVDNLGVLTMQAAITGKSRVDGKTAIVNLNYTHEENVFTLWRSLRFGDNLQAWLEQNTALPQPPCRKDKDCEDK

SEQ ID NO: 14801 - DNA, 2637 bp, Salmonella typhimurium LT2
  CDS (1)..(2637): transl_table=11
atgaagggtaaatataaagccgcccttgcgctactgttactgctgattcttatccctctgacgctactgatgaccctcgggctgtgggttcccactctggcgggaatttggctacccgtcggtacccgtatcgctctggaacaaagtccacgcctgacacgtcatgggttagtgattcccgatcttcgctatctggtcaatgattgttcgttagcgcatattacccaggcggaactgacgcatcccagccgttggttgctgaatattaaaagccttaaactggatgccgcgtgcctggcgaaactgcccgctacggaagcttctcccgccgcgccgcgtacgctggcgcagtggcagtcaatgctgcccaatacctggattaacatcgataatgtcattctcgcgccctggccggaatggcagggcaagctggcgatctccatgacgccggtcattcagcagatacgttatcagggcgaaaaagtaaaatttcaagggcagctacgcggtcaggcattgacggtgagccaactggagatcgccgcgctggccaaccagcctcccgttagcctggcgggggaatttgtgttgccgctggtaccggatggcctgccggtcagcggtcatgcggcagcgaccttgcgtctgccgcaggaaccgtcgctggtggatgcggaactggagtggcgtgataacgccggacagctcatcgtgatggcgcgaggtaatcctgacccgattctcgatctcccctgggcggtaacgcgtcagcggcttaccatcagcgatggccgctggaactggccatatcagggattccccttgagcggacgtctggcttttaatatcgataactggcaagccgggccggataatgcgcaagtcagtggacgcctgaatattctgacccagggcgatgccggtaaagcgaacgctgtactgactatcggcccgggaaaactcagcatggatagcagtgagatgcctctacagcttaccggcgaggctaaacagaaggatttaatcttttatgccgtattgcccgctatgttccgcggcagtctggccgatccgcagctcacctttgcacctggcgcattgctacgctcgcgcgggcgggtgattgatgcgttagatattgatgaaattcgttggccgctggcgggcgttaaggtgacgccgcgcggcgttgatggccgattacaggctattttacgggcgcacgaaaatgagatgggcgatttcgttcttcatcttgatggcctggccaatgattttctccctgatgctggtcgctggcggtggcgctattgggggcaaggaagctttacgccaatgcgcgcccactgggatattgccggacagggcgaatggcatgataacaccatcaggttgaccagtttgtccaccggttttgatcagttgcactatggcgcaatgaccgtcacatcgccaagactggcgctgaataaacctattgtctgggttcgcgacgccacaacgccgtcgctacagggcgcgctgtctctggtggcggggaaaaccgtatttaccagtgggagcgtgctgccgccttctacccttaattttagcgttgaagggcgagagccaaccctgttccagtttaaaggcgaccttcgggcgggggcgatagggccggtacggctgaatgggcgctgggatggcgaacgccttcgtggacaggcctggtggccgaagcagtcgcttatcgttttccagccgttgcttccaccggactggaaaatgacgctgcgcgaaggctcactgtatgcgcaggtggctttttccgctgcgcaggggcagggatttgaagcaggtggacacggcgtgttaaaaggcggcagcgcctggatgcctgataacaaaatcaacggcgtcgatttcattctgccatttcgcttccacaacggcgcgtggcaattggggacgcgcgggcccatctcgctgcgtatcgccgggatagttaaccaggtcacggcgaaaaatatcaccgctgatttacagggcggttatccctggagcgagtcgaatccattactgctaagcgatgtcagcgtagacgtgctgggcggtcaaatcattatgaaacagttgcgaatgccgcagcacgacccggcgcttttgcgggtgcaaaatatttcatccagcgaattgattagcgccataaatccaaagcaattcgccatgtctggtccggtcagcggcgcgctgccgctgtggctgaacaatgaaaaatggataatcaaagatggctggcttacgaatcctgggccaatgacgttgcgtatcgataaagatactgcggatgcggtggtgaaggataatgtcacggcaggctcggcgatcaactggctacgttatatggagattacgcattcgtggacgaaaattaacgttgataacctgggcgtactaacgatgcaggcggctattaccggcaaaagccgggtagatggtaaaaccgcgatcgttaacttgaactatacccatgaagaaaatgtgtttacgctgtggcgcagtttgcgttttggcgacaatttacaggcatggcttgaacaaaatacagcgttgccgcaacctccttgccggaaagacaaggactgtgaggataaataa

SEQ ID NO: 14802 - protein, 878 aa, Salmonella typhimurium LT2
MKGKYKAALALLLLLILIPLTLLMTLGLWVPTLAGIWLPVGTRIALEQSPRLTRHGLVIPDLRYLVNDCSLAHITQAELTHPSRWLLNIKSLKLDAACLAKLPATEASPAAPRTLAQWQSMLPNTWINIDNVILAPWPEWQGKLAISMTPVIQQIRYQGEKVKFQGQLRGQALTVSQLEIAALANQPPVSLAGEFVLPLVPDGLPVSGHAAATLRLPQEPSLVDAELEWRDNAGQLIVMARGNPDPILDLPWAVTRQRLTISDGRWNWPYQGFPLSGRLAFNIDNWQAGPDNAQVSGRLNILTQGDAGKANAVLTIGPGKLSMDSSEMPLQLTGEAKQKDLIFYAVLPAMFRGSLADPQLTFAPGALLRSRGRVIDALDIDEIRWPLAGVKVTPRGVDGRLQAILRAHENEMGDFVLHLDGLANDFLPDAGRWRWRYWGQGSFTPMRAHWDIAGQGEWHDNTIRLTSLSTGFDQLHYGAMTVTSPRLALNKPIVWVRDATTPSLQGALSLVAGKTVFTSGSVLPPSTLNFSVEGREPTLFQFKGDLRAGAIGPVRLNGRWDGERLRGQAWWPKQSLIVFQPLLPPDWKMTLREGSLYAQVAFSAAQGQGFEAGGHGVLKGGSAWMPDNKINGVDFILPFRFHNGAWQLGTRGPISLRIAGIVNQVTAKNITADLQGGYPWSESNPLLLSDVSVDVLGGQIIMKQLRMPQHDPALLRVQNISSSELISAINPKQFAMSGPVSGALPLWLNNEKWIIKDGWLTNPGPMTLRIDKDTADAVVKDNVTAGSAINWLRYMEITHSWTKINVDNLGVLTMQAAITGKSRVDGKTAIVNLNYTHEENVFTLWRSLRFGDNLQAWLEQNTALPQPPCRKDKDCEDK

SEQ ID NO: 14803 - DNA, 2640 bp, Shigella flexneri 2a str. 301
  CDS (1)..(2640): transl_table=11
atgctgggtaaatataaagccgttctcgcgctgttattactgattattcttgtgccgttgacgctgctgatgacgctcgggctgtgggttcccacgctggcggacatctggctaccgctcgggacacgtattgcattagatgaaagcccacgcattacgcgtaaaggtttaatcattcccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagctgctccaaaaaccctcgcgcagtggcagtccatgctgcctaacacctggatcaatatcgataaactgattttttctccctggcaggaatggcagggaaaactctctctcgcattaacctctgatatccagcaactgcgttatcagggcgaaaaagttaaatttcaaggccagctgaaagggcaacaacttacagtcagcgaactggatgtcgtcgcgtttgaaaatcagccgccggttaaactggtgggggaatttactatgccgctcgtgccggatggacttcctgtaagtgggcatgctactgcgacgttaaacttgccgcaggaaccgtcactggtggatgccgagctggactggcaggaaaatagcgggcaattgatcgtgctggcacgggataacggcgatccgttgctcgatttgccgtggcaaattactcgtcaacaattgaccgtaagcgatggtcgctggagctggctgtatgctggttttcctttgagtggccgactgggtgtcaaagtcgacaactggcaggcagggcttgagaacgctctggtcagcggacgactgaatgtgctgacccaggggcaagcgggtaagggcaacgcggtgcttaattttggcccaggaaaattaagcatggataacagtcaactgcctctgcagctgaccggtgaagcgaaacaggcggacctcattttatatgcccgtttacctgcgcagctaagtggaagtctgtctgacccaacgctgacctttgagccaggcgcgttacttcgttcaaagggaagagtcatcgattcgctggacatcgatgaaatccgctggcctttagcgggtgtaaaagtcacccaacgtggtgttgacggacgtttgcaggccattttgcaggcgcatgaaaatgaactgggcgatttcgtgctgcatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccgtcgtctgggtacgtgacgcacagcatccctccttcagcggcgcgctgtcactggacgccgggcaaacgctgttcactggcggcagtgtgttaccgccatcaaccttaaaatttagcgtcgatgggcgcaatccgacctatttcctctttaaaggcgatttacatgctggtgagattggcccggttcgggtaaatggtcgctgggacggtattcgtctgcgcggtaacgcctggtggccaaaacaatcactgactgtattccagccgctggtgccacccgactggaagatgaacttacgcgatggtgaactgtatgctcaggttgcattttctgctgcgcctgaacaaggattccgcgcgggagggcacggcgtgttgaaaggcggtagtgcctggatgccagataatcaggttaacggtgtcgattttgtcctgcctttccgttttgccgatggagcctggcatctggggactcgcggccccgttacgttgcgaattgccgaagtgattaatctggtgacagcgaaaaatattacggctgatttgcaagggcgttatccgtggactgaagaagaacccttgctgttgactgatgttagcgtcgatgtgttaggcggtaacgtgctgatgaaacaattacgtatgccgcaacatgacccggcgctgttgcggctgaataatctctcatccagcgaactggttagcgccgtcaatccgaaacaattcgccatgtccggggcatttagtggtgcattgccgttatggctaaacaacgaaaaatggatagtgaaagatggttggctggcaaatagcgggctaatgaccttgcggctggataaagataccgcagatgcggtggtgaaagacaatatgactgcgggttcagcaattaactggttgcgctatatggaaattagccggtcatcgacaaaaattaacttagataatctcggtttattaaccatgcaggccaacattacaggtaccagtcgcgttgatggtaaaagcggtacggtaaaccttaattaccatcatgaagagaatatttttacgctgtggcgcagtttacgctttggcgataatctccaggcatggttggagcagaacgcacgtctgccgggaaatgactgtccgcaaggaaaagagtgtgaggaaaaacaatga

SEQ ID NO: 14804 - protein, 879 aa, Shigella flexneri 2a str. 301
MLGKYKAVLALLLLIILVPLTLLMTLGLWVPTLADIWLPLGTRIALDESPRITRKGLIIPDLRYLVGDCQLAHITNASLSHPSRWLLNVGTVELDSACLAKLPQTEQSPAAPKTLAQWQSMLPNTWINIDKLIFSPWQEWQGKLSLALTSDIQQLRYQGEKVKFQGQLKGQQLTVSELDVVAFENQPPVKLVGEFTMPLVPDGLPVSGHATATLNLPQEPSLVDAELDWQENSGQLIVLARDNGDPLLDLPWQITRQQLTVSDGRWSWLYAGFPLSGRLGVKVDNWQAGLENALVSGRLNVLTQGQAGKGNAVLNFGPGKLSMDNSQLPLQLTGEAKQADLILYARLPAQLSGSLSDPTLTFEPGALLRSKGRVIDSLDIDEIRWPLAGVKVTQRGVDGRLQAILQAHENELGDFVLHMDGLANDFLPDAGRWQWRYWGKGSFTPMNATWDVAGKGEWHDSTITLTDLSTGFDQLQYGTMTVEKPRLILDKPVVWVRDAQHPSFSGALSLDAGQTLFTGGSVLPPSTLKFSVDGRNPTYFLFKGDLHAGEIGPVRVNGRWDGIRLRGNAWWPKQSLTVFQPLVPPDWKMNLRDGELYAQVAFSAAPEQGFRAGGHGVLKGGSAWMPDNQVNGVDFVLPFRFADGAWHLGTRGPVTLRIAEVINLVTAKNITADLQGRYPWTEEEPLLLTDVSVDVLGGNVLMKQLRMPQHDPALLRLNNLSSSELVSAVNPKQFAMSGAFSGALPLWLNNEKWIVKDGWLANSGLMTLRLDKDTADAVVKDNMTAGSAINWLRYMEISRSSTKINLDNLGLLTMQANITGTSRVDGKSGTVNLNYHHEENIFTLWRSLRFGDNLQAWLEQNARLPGNDCPQGKECEEKQ

SEQ ID NO: 14805 - DNA, 2640 bp, Escherichia coli CFT073
  CDS (1)..(2640): transl_table=11
atgctgggtaaatataaagccgttctcgcgctgttattactgattattcttgtgccgttgacgctgctgatgacgctagggctgtgggttcccacgctggcgggcatctggctaccgctcgggacacgtattgcattagatgaaagcccacgcattacgcgtaaaggtttaatcatccccgatctccgttatctggtgggagattgtcagcttgcgcatatcaccaacgccagcctttcacatcccagccgctggttattgaacgtcggcacggtagaacttgattctgcttgtctggcgaaattgccgcagacggagcaatcgccagccgctccaaaaaccctcgcgcagtggcagtccatgctgcctaacacctggatcaatatcgataaactgattttttctccctggcaggaatggcagggaaaactctctctcgcattaacctccgatatccagcaactgcgttatcagggcgaaaaagttaaatttcaaggccagctgaaagggcaacaacttacagtcagcgaactggatgtcgccgcgtttgaaaatcagccgccggtaaaactggtgggggaatttactatgccgctcgtgccggatggacttccggtaagtggtcatgctactgcgacgttaaacttaccgcaggagccttcactggtggatgccgagctggactggcaggaaaatagcgggcaattgattgtgctggcacgggataacggcgatccgttgctcgatttgccgtggcaaattactcgtcaacaattgaccgtaagcgatggtcgctggagctggccgtatgcaggttttcctttaagtggccgactgggtgtcaaagtcgacaactggcaggcagggctcgagaacgctctggtcagcgggcgactgagtgtgctgacccagggacaagcgggtaaaggcaacgcggtgttaaattttggcccaggaaaattaagcatggataacagccagctgtctctgcagctgaccggtgaagcgaaacaggcggacctcattttatatgcccgtttacctgcgcagctaagcggaagtctgtctgacccaacgctgacctttgagccaggcgcgttattacgttcgaagggaagagtcattgattcgctggacatcgatgaaatccgctggcctttagcgggtgtaaaagtcacccaacgtggtgttgacggacgtttgcaggccattttgcaggcgcatgaaaatgaactgggcgatttcgtgctacatatggatgggctggcgaatgattttctccctgacgctggccgctggcagtggcgctactggggaaaagggagttttacaccgatgaatgccacctgggatgtcgcaggaaaaggtgagtggcatgacagcacgattacgctgaccgatctctccaccggtttcgaccagttacaatacggtacgatgacggtagaaaagccgcgattaattctcgacaagcccgtcgtctggggacgtgacgcacagcatccctcattcagcggcgcgctgtcactggacgccgggcaaacgctgttcactggcggcagtgtgttaccgccatcaaccttaaaatttagtgtcgatgggcgtgatccgacgtatttcctctttaaaggcgatttacatgctggtgagattggcccggttcgggtaaatggtcgctgggacggtattcgtctgcgcggtaacgcctggtggcctaaacaatcactgactgtattccagccgctggtgccacccgactggaagatgaacttacgcgatggtgaactgtatgctcaggttgcattttcagctgcgcctgaacaaggattccgcgcgggagggcacggcgtgttgaagggtggtagtgcctggatgccagataatcaggttaacggtgtcgattttgtcctgcctttccgttttgccgatggagcctggcatctggggactcgcggtcccgttacgttgcgaattgccgaagtgattaatctggtgacagcgaaaaatattacggctgatttgcaaggtcgttatccgtggactgaagaagaaccattgctgttgactgatgttagcgttgatgtgttaggcggtaacgtgctgatgaaacaattacgtatgccgcaacatgacccggcgctgttgcggctgaataatctttcctccagcgaactggttagcgccgtcaatccgaaacaattcgccatgtccggggcatttagtggtgcattgccgttatggctaaacaacgaaaaatggatagtgaaagacggctggctggcaaatagcgggccaatgaccttgcggctggataaagacaccgcagatgcggtggtgaaagacaatatgaccgcgggttcagcaattaactggttgcgctatatggaaattagccgttcatcgacaaaaattaatttagataatctcggtttattaaccatgcaggccaatattacaggtaccagtcgcgttgatggtaaaagcggtacggtaaatcttaattaccatcatgaagagaatatttttacgctgtggcgcagtttacgctttggcgataatctccaggcatggctggagcagaacgcgcgtctaccgggaaatgactgttcgcaaggaaaagagtgtgaggataaacaatga

SEQ ID NO: 14806 - protein, 879 aa, Escherichia coli CFT073
MLGKYKAVLALLLLIILVPLTLLMTLGLWVPTLAGIWLPLGTRIALDESPRITRKGLIIPDLRYLVGDCQLAHITNASLSHPSRWLLNVGTVELDSACLAKLPQTEQSPAAPKTLAQWQSMLPNTWINIDKLIFSPWQEWQGKLSLALTSDIQQLRYQGEKVKFQGQLKGQQLTVSELDVAAFENQPPVKLVGEFTMPLVPDGLPVSGHATATLNLPQEPSLVDAELDWQENSGQLIVLARDNGDPLLDLPWQITRQQLTVSDGRWSWPYAGFPLSGRLGVKVDNWQAGLENALVSGRLSVLTQGQAGKGNAVLNFGPGKLSMDNSQLSLQLTGEAKQADLILYARLPAQLSGSLSDPTLTFEPGALLRSKGRVIDSLDIDEIRWPLAGVKVTQRGVDGRLQAILQAHENELGDFVLHMDGLANDFLPDAGRWQWRYWGKGSFTPMNATWDVAGKGEWHDSTITLTDLSTGFDQLQYGTMTVEKPRLILDKPVVWGRDAQHPSFSGALSLDAGQTLFTGGSVLPPSTLKFSVDGRDPTYFLFKGDLHAGEIGPVRVNGRWDGIRLRGNAWWPKQSLTVFQPLVPPDWKMNLRDGELYAQVAFSAAPEQGFRAGGHGVLKGGSAWMPDNQVNGVDFVLPFRFADGAWHLGTRGPVTLRIAEVINLVTAKNITADLQGRYPWTEEEPLLLTDVSVDVLGGNVLMKQLRMPQHDPALLRLNNLSSSELVSAVNPKQFAMSGAFSGALPLWLNNEKWIVKDGWLANSGPMTLRLDKDTADAVVKDNMTAGSAINWLRYMEISRSSTKINLDNLGLLTMQANITGTSRVDGKSGTVNLNYHHEENIFTLWRSLRFGDNLQAWLEQNARLPGNDCSQGKECEDKQ

SEQ ID NO: 14807 - DNA, 2628 bp, Photorhabdus luminescens subsp. laumondii TTO1
  CDS (1)..(2628): transl_table=11
ttgataaccaaagggttaaaaatattcattaccatactgatgttatcggtattgctgatagcagtgggatggttttctattcctcattggttacctaaggtcactggtcgctggttacctccaggtatgatggtttcattgaaacaaccaaaatggaaaaatggggctttgcaattggatgatatttcattgcaggtgaaggattgcaggcttattcgtgtatcgcgattatctgttagttacccatattcagagatagataacagttatcattggcgattaaatgccgcagatattagcggggatatcaattgcctaaatcagttacctaaatcgacacaaagccatgatccactgtctgttgctgatattttagctcttattccacagggaagtttgtccgtggaaaatctttcttttcatccctggcaagattttgctggaagactagaattcaattcctcttctcaggggcaagaactcagttatcaggggaagaaggttaaattgtcagcgcatatttatggtaaggaatcgctagttattgaccaactggcaattaaattaccagaacaggaaatcagccttaatggtgaaatgacattacctcttaatgtggacaaattaccgcctcatggtgatgtaaaaggtaaaattattgccaggcaatatgcgcacccgctgaatatcaagttaggttggcgagggacatccggcaaacttattatcggcgaagaggggacaacagtacctttggccgaattgccttggcagtttaaccaagaccagtttgatattactgatggtaaatggcagtggacgagtgcggaacaacctcttgcgggaggagtgaatattaagattgctcattggcaacaagggttggataacctgctaatgagtggtcgtataaatttggtcactcagggtaaacgtggtaaagcgaatattgtgttaacgataaaaccgggccggataaattcattaaatacgcaacttcctttgcaattaacgggtcagattaatgtgcaggatatgatgatggctatgtcattgcctgcgataattgatggtccgctggttaatccgaaaatgactttccagtcaggttcgttgtttcgggtttgggggcgattgtctgatgagtttatggttaaagatgcccgatcaccgttagcgggaacttatctgacacgtgaaggttttacgggtcggttacaggcgattgttaatgcgcaacaccgtgactggggaaaattccgtttgcatctagatggtcatgccgaggattttatgccggataaaggctattggcgttggaactattggggagatggctatttgccgccactacaggctaaatgggatatcgttggaaaagggcgttggcatgacacattgattaacgtcaacgaaatgactaccggttttaatgtgattaagcacggtatgattcgggtggatacgccgcgtctacaattaacaaaaccattggaatggcaacgttcagagaaattgcccgcctttaagggtgagttacggctgacagcgaagaaaacatcatttcggtccggtggctttttgccccctgctgagctgacagcaaaattgacaggagaaagcccgaataactttattgttaatggtgatctttcatcaagaaatattggtccgatccctttttacagtcgttgggatggagcaagattgcgtggtgaagcgcgttggcctactcaatccttacttgcatttcagccgttggtacctaaagatttaggcataaacttacgatcaggtgatctttatgcgcaggccgctttttctgccacacgagggcaaggttttgttgcggggggacactgggtagtaaaaaatggcagcatgtggcttaaagagggtgaaatcagtggacttgattttgtcttaccgtggcggctgaaagagagtatctggcaatttggtgttaaatcgccggttcaactacgagtgaaaacgattaataacctgtttgaaatgcgtaacttgacggcggacttacagggattttatccaccatcggaacaaaaaccgctggaattgactaatgtgaatgtaggtatattggatggacagattaacttagataaattaaggcttcctcagcatcatcctgctattttggcgcttgataaattggagttaagtcgccttcttactgtgttgaaagtcaaacaatttgcgatatccggcaaaatcagcggaaaattgccgttgtttattaataatgaacgttggatagttcagcaaggtcagattaccaatatcgaccatatgaccttacgtctggataaagacacggtagattccattaacaaagataatatttccgctggtgccgctatggattggttacgctatttagaaatcagtcgtttacgggcgcagctcagtcttgataatttagggattctggcacttagcgctgaaattcaaggtgttaattcattaagagataaaaaacggcaagtcaagctgaattaccatcatgaagagaatatctttcacttatggcgcagcttacggtttggcaacaatcttgaagattggttacagcaaaatatctctgtattaaatgggagtgataaatga

SEQ ID NO: 14808 - protein, 875 aa, Photorhabdus luminescens subsp. laumondii TTO1
MITKGLKIFITILMLSVLLIAVGWFSIPHWLPKVTGRWLPPGMMVSLKQPKWKNGALQLDDISLQVKDCRLIRVSRLSVSYPYSEIDNSYHWRLNAADISGDINCLNQLPKSTQSHDPLSVADILALIPQGSLSVENLSFHPWQDFAGRLEFNSSSQGQELSYQGKKVKLSAHIYGKESLVIDQLAIKLPEQEISLNGEMTLPLNVDKLPPHGDVKGKIIARQYAHPLNIKLGWRGTSGKLIIGEEGTTVPLAELPWQFNQDQFDITDGKWQWTSAEQPLAGGVNIKIAHWQQGLDNLLMSGRINLVTQGKRGKANIVLTIKPGRINSLNTQLPLQLTGQINVQDMMMAMSLPAIIDGPLVNPKMTFQSGSLFRVWGRLSDEFMVKDARSPLAGTYLTREGFTGRLQAIVNAQHRDWGKFRLHLDGHAEDFMPDKGYWRWNYWGDGYLPPLQAKWDIVGKGRWHDTLINVNEMTTGFNVIKHGMIRVDTPRLQLTKPLEWQRSEKLPAFKGELRLTAKKTSFRSGGFLPPAELTAKLTGESPNNFIVNGDLSSRNIGPIPFYSRWDGARLRGEARWPTQSLLAFQPLVPKDLGINLRSGDLYAQAAFSATRGQGFVAGGHWVVKNGSMWLKEGEISGLDFVLPWRLKESIWQFGVKSPVQLRVKTINNLFEMRNLTADLQGFYPPSEQKPLELTNVNVGILDGQINLDKLRLPQHHPAILALDKLELSRLLTVLKVKQFAISGKISGKLPLFINNERWIVQQGQITNIDHMTLRLDKDTVDSINKDNISAGAAMDWLRYLEISRLRAQLSLDNLGILALSAEIQGVNSLRDKKRQVKLNYHHEENIFHLWRSLRFGNNLEDWLQQNISVLNGSDK

SEQ ID NO: 14809 - DNA, 2697 bp, Yersinia pestis biovar Microtus str. 91001
  CDS (1)..(2697): transl_table=11
atggctaaatgcgcaaaaatagtagtcgggttgttattaataagcgcactgtcgctgctcgtgttatggaaaactctgccgacatggttaccgagagtcgccgggtattggttacctgcgggtagccaactgcaattacccgttcttcctgtgtggcgtaatggcgcgttgcgtgtcgagcaactgcgttatttggctcaggattgtacgctcgctaatatcagtcaactgagtataggttatcaccaaggacgctggcagttgggtgcgggtgatgtggtgctggagactgcttgtttgagtcagttaccgtctggcggtgatagctctccgctcgatttggcgcaatggcagcagcaactgtcccgttttgatcttactatcaatcatctgctggtcaccccttggcagcaatatgcaggcaagctgacactgacatcacctgacaacaataaatctcttcagacactcggttatcaggggcagcaactcagctttgctgtgacgttgaatgaacaacagcagcttagtttgaatcagttctctatggccattcccggtatgcctcaactgtttcagcttagcggtaaaattaaaatcccgttgtcattggatgagtggccagagcaaggcgcattagatgggctattgaccaccggttatttgtcgaagccgctgctattgaacttgagttggcagcaacagcagggcgtattgaccttaactgagcgtggcgataaccaacctttagcgcgtttaccctggcaagcctcggcgaatcttattcagatcgtgaacggtcagtggcaatggccatatggtcaacagccgttgaaggggggcgttaacctgacactacacgattgggatcaaggattggaacagacctcgattgatgcacggattaacgtgattacctcggggaaaaatggcaaagggaacgccgtattgacgctggggccgggcaatttgggtttaattaacagtgagttaagattccaactaagtgggcaagtaaatctggaaaccatggtgtttaacgccacgatccccggtttacttagcggttcagtattgaatccgacgtggatattgtcccccggcgccttgctgcgtacttatggtaatctgaccccggaattgcggataaaagatgctcgttggccgctggcgggtatccgggtgaccgccgcgggtgttacggggcgtttacaggcaatcgttgatgctcaggatagctactgggggagtgtcaatctgcatttggatgggcaggcacaagcgttttggccagataagggcaattggcaatggcgctattgggggagcggaaacttgccaccattagcggcacgctgggatgtgggggggacggggagttggcgggatacgctgattacggtggatacgctgtcaacggggtttgatcgtttacaatatggcctagtcaaggtggacgcaccacgtttgatattgacgaaaccgctgacctggcaacgagataaccaccaccccgcgtttattgcaggtctgaaactgagcgctaaaaaagtggagttcagtgatggtggcggttatctccccccgtcagtgttatcactgcaattcaatggccgcgatctcgatagtttcctctggcaagggcaattgcaagctcagtctatcgggccaattccgctacgtggccgctgggatggtgagcgcttgcgtggtgagggttggtggcctaagcagtcattaatggtcttccagccactgatttcaaaagatctggggatcaaactgcgggacggtacgttttatgcgcaagccgcattctctgcggcgcgtgaacaagggtttactgccggtgggcattgggtggtaaacaatggcggcatgtggctgcaggacggtgagttaagcgggctagattttgtcatgtcgtatcgtttacagaaccatcactggcagttaggggctaaagagccggtaatgctacgtatcgcttcgttgaataacctctttgatatgcagaatattactgctgatttacaggggacttatccttattcagaaacggcaccactaacattaagcaatgttggcatggatattttgaacggccacctgagcttgtctgcgctgcgtttgccacaacatgatgccgccgtcctcaaattaagtcagattgatctgagcgcgttgttcaccgtattacaaccgaagcaatttgcgatgtcgggtaaagtgaacggcgaattaccgctttatcttaataacccacagtggctggtgcgtaatggttggattgccaatgacggcatgctgacattacggctcgataaagacctgaccgattctatcagtgagagcaatactgtcgccggtgcggcgattgactggttgcgttacatggagatttctcaatcgtataccaaagtggatctggataatctggggcagttgacgctaacctctaaagttcatggtgtgaattcgcaaaaaaatagcacacgggcggtagtactgaattaccagcaccaggagaacctgttccaactttggcgcagcctacgatttggtgacaatttacaagagtggttgcaacagactatttcattaccatcagcgagttcattaccgtccgcgagttcattaccgcaaggtatttcatcacaaccaacagcaccaataccgacgagggcgaaggaatga

SEQ ID NO: 14810 - protein, 898 aa, Yersinia pestis biovar Microtus str. 91001
MAKCAKIVVGLLLISALSLLVLWKTLPTWLPRVAGYWLPAGSQLQLPVLPVWRNGALRVEQLRYLAQDCTLANISQLSIGYHQGRWQLGAGDVVLETACLSQLPSGGDSSPLDLAQWQQQLSRFDLTINHLLVTPWQQYAGKLTLTSPDNNKSLQTLGYQGQQLSFAVTLNEQQQLSLNQFSMAIPGMPQLFQLSGKIKIPLSLDEWPEQGALDGLLTTGYLSKPLLLNLSWQQQQGVLTLTERGDNQPLARLPWQASANLIQIVNGQWQWPYGQQPLKGGVNLTLHDWDQGLEQTSIDARINVITSGKNGKGNAVLTLGPGNLGLINSELRFQLSGQVNLETMVFNATIPGLLSGSVLNPTWILSPGALLRTYGNLTPELRIKDARWPLAGIRVTAAGVTGRLQAIVDAQDSYWGSVNLHLDGQAQAFWPDKGNWQWRYWGSGNLPPLAARWDVGGTGSWRDTLITVDTLSTGFDRLQYGLVKVDAPRLILTKPLTWQRDNHHPAFIAGLKLSAKKVEFSDGGGYLPPSVLSLQFNGRDLDSFLWQGQLQAQSIGPIPLRGRWDGERLRGEGWWPKQSLMVFQPLISKDLGIKLRDGTFYAQAAFSAAREQGFTAGGHWVVNNGGMWLQDGELSGLDFVMSYRLQNHHWQLGAKEPVMLRIASLNNLFDMQNITADLQGTYPYSETAPLTLSNVGMDILNGHLSLSALRLPQHDAAVLKLSQIDLSALFTVLQPKQFAMSGKVNGELPLYLNNPQWLVRNGWIANDGMLTLRLDKDLTDSISESNTVAGAAIDWLRYMEISQSYTKVDLDNLGQLTLTSKVHGVNSQKNSTRAVVLNYQHQENLFQLWRSLRFGDNLQEWLQQTISLPSASSLPSASSLPQGISSQPTAPIPTRAKE

SEQ ID NO: 14811 - DNA, 2640 bp, Klebsiella pneumoniae subsp. pneumoniae MGH 78578
  CDS (1)..(2640): transl_table=11
atgaagggtaaatataaagccgccatcgcgctggtgttagttctggtgttattgccgctaaccctgctgttgacgctaacccactgggtgccgacgctggcgggcatctggctgcccgtgggcacgcgtatctctttgcaggagagcccgcgcctgacgcggtcggccctgctgatccccgatctgcgttatctggtgggcgactgtgaaatcgcccgggtgaccgatgcccgtctctcgcgtcccagccgctggcggctgcatattggccagctggagatcaacagcgcctgcctgagcaaactgccggccagcgatccctctcccggttcaccgcgcacgcttgccgaatggcaatcgatgttgccctatagctggttaaccattgacaatctgcggctctcgccgtgggagaaatggcaggggcggctggtaatgtcattaacgcctgcgcagcaggatatcggctttgccgggaaggaactgagtctgcaggcgcgcctgcgcggccaggcgctcaccgtcagccagttcagcgcccggctgactgacgatcagccgccggtgaagttggtggggaccttccatctgccgctggtgccggatggtctgccggtcgacggccagatgcagggcaccttcgaattcccgcagactgcggaatggatcgatgctgagctcgagtggcagcacaatcgcggccagctgctggtcaccccgcggggtgaggtagagcctattctggacctgccgtgggagatcaccccggagcggatcaccatcagcgacggccgctggcgcacccgttacgaggcgtatccgctgcgcgggcgggtggcgctgtcggtgggtaactggcagcagggcaccgaacagatgatcgtcagcggtcgcctgaatgttctcaccgagggtcatgccgggaagggcaatgcggtactgaatattggtccgggcaagctgagcatggataacagcgatctgccgctgcggctcaccggcgaggccaagctgggggagatgatactatacgcggcgctgccggctcagctcagcgggccgctgatcagcccgcagttggcttttcaccccggtgcgttgctgcgttcgcgcgggcgggtgatcgacgcgctgaatattgacgaaatccgctggccgctggccggggtaaaggtcacccagcagggcgtcgatggccgcctgcaggcgatccttcgcgcccatgagcagcagatgggcgactttacgctgcatctggacggtcaggcgagcgattttctgcccgacagcggccgctggcagtggcgctactggggcgagggacattttaccccgatgcaggcgcgctgggatgtgaagggcagcggggagtggcgcgacaatgctattaccctgagcagcctctccaccggcttcgataagcttgagtacggcacaatgcgggtcagcaccccgcgtctgaccctcgagcagccgatccgctggctgcgtgatgctgagcatccgcggttgaccggcgcgctgtcgctggacgccgccaaaaccaccttctccggcggcagctatctcccggcctcaacgctgaaattcgccctcgacggtcgggacccgacgtggttccagttcaccggcgccctgcatgccgaggctatcggtccggtgcgtctgtccgggcgctgggacggcgaacggctgcgcggccaggcgtggtggccaaaacagtcgctaacggtgttccagccgctggtgccgccggactggaagatgaacctgcgtgaaggcagtctctacgcgcaggtggccttctcggcggcagccgggcagggatttgaggcgggcggccatggcgtcctgaagggcggcagcgcctggatgccggataaccagatcaacggcgtcgatttcgtcctgccgttccgcttcagcgacggtcactggcagctgggcatccgccgcccggtctccctgcgcattggcgaaatcgtcaaccaggtcaccgcgcgtaatctgacggcggacctgcagggcacctggccgtggagcgaggccaatccgctgcagctcagcgacgtcagcgtcgatctgttaggcgggaaactgacgctgctgcagctgcgtatgccgcagcgcgacccggcgttgatccgcctgcagcatatctccagcagcgaactgaccagcgccgtcaaggtgaaacagttcgccatgtccggcgcggtgagcggcgcgttgccgctgtggctggagaataatcaatggatcatccacgacggctggctgcgcaatgacggaccgatgaccctgcggctggataaagacaccgccgatgcgctggtggcggataacgtctccgccggggcggcgattaactggctgcgctatatggaaatctcccgctcgtggacgcagattaacctcgataatctgggcgtgttgacgcttaaggccagcatcaacggcaccagccgggtggaagggaaaagcagtaccgtgcatttaaactacgctcatgaagagaatattttcgacctgtggcgcagcttgcgcttcggcgacaatttacaggcgtggctcgagcagaatgctacgctgcccgtacggcgctgtacggacggtaagacatgtaaggaacctaaatga

SEQ ID NO: 14812 - protein, 879 aa, Klebsiella pneumoniae subsp. pneumoniae MGH 78578
MKGKYKAAIALVLVLVLLPLTLLLTLTHWVPTLAGIWLPVGTRISLQESPRLTRSALLIPDLRYLVGDCEIARVTDARLSRPSRWRLHIGQLEINSACLSKLPASDPSPGSPRTLAEWQSMLPYSWLTIDNLRLSPWEKWQGRLVMSLTPAQQDIGFAGKELSLQARLRGQALTVSQFSARLTDDQPPVKLVGTFHLPLVPDGLPVDGQMQGTFEFPQTAEWIDAELEWQHNRGQLLVTPRGEVEPILDLPWEITPERITISDGRWRTRYEAYPLRGRVALSVGNWQQGTEQMIVSGRLNVLTEGHAGKGNAVLNIGPGKLSMDNSDLPLRLTGEAKLGEMILYAALPAQLSGPLISPQLAFHPGALLRSRGRVIDALNIDEIRWPLAGVKVTQQGVDGRLQAILRAHEQQMGDFTLHLDGQASDFLPDSGRWQWRYWGEGHFTPMQARWDVKGSGEWRDNAITLSSLSTGFDKLEYGTMRVSTPRLTLEQPIRWLRDAEHPRLTGALSLDAAKTTFSGGSYLPASTLKFALDGRDPTWFQFTGALHAEAIGPVRLSGRWDGERLRGQAWWPKQSLTVFQPLVPPDWKMNLREGSLYAQVAFSAAAGQGFEAGGHGVLKGGSAWMPDNQINGVDFVLPFRFSDGHWQLGIRRPVSLRIGEIVNQVTARNLTADLQGTWPWSEANPLQLSDVSVDLLGGKLTLLQLRMPQRDPALIRLQHISSSELTSAVKVKQFAMSGAVSGALPLWLENNQWIIHDGWLRNDGPMTLRLDKDTADALVADNVSAGAAINWLRYMEISRSWTQINLDNLGVLTLKASINGTSRVEGKSSTVHLNYAHEENIFDLWRSLRFGDNLQAWLEQNATLPVRRCTDGKTCKEPK

SEQ ID NO: 14813 - DNA, 2637 bp, Salmonella enterica subsp. arizonae serovar 62:z4,z23:--
  CDS (1)..(2637): transl_table=11
atgaagggtaaatataaagccgcccttgcgctactgttactgctgtttcttgtgccgctgacgctgctgatgaccctgggactgtgggttcccactctggctggaatctggctacctgtcggcacccgtatcgccctggaagaaagtcctcgcctgacgcgtcatggggtagtgatccccgatcttcgctatctggtgaatgattgtccgttagcccatattacccaggcggaactgacgcaccccagtcggtggttgctgaacatcaaaagcctggaactggatgccgcgtgcctggcgaaattgccggcctcggaagcctctcccgccgcgccgcgtaccctggcgcagtggcagtcaatgctgccaaatacctggattaacatcgataatgtcattctcgcgccctggccggaatggcaggggaaactggcgatctccatgacaccagtcgttcagcagatacgttatcagggcgaaaaagtaaaatttcaggggcagctacacggtcaggcgttgacggtgagccaactggagatcgccgcgctggcgaaccaacctcctgtcagtctggcgggggagtttacgttgccgctagtaccggatggcctgccggtcagcggtcatgcggcggcgacgttgcgtttgccgcaggaaccgtcgctggtggatgcggaactggaatggcgtgataacgccggacaactcatcgtgatggcgcgaggcaatcctgacccaattctcgatctcccgtgggcggtaacgcgccagcggctgaccatcagtgatggccgctggaactggccataccggggattcccactgagcggacgtctggcttttaatatcgataactggcaggcagggctggacaatgcgcgggtcagcggtcgcctgaatatactgacccatggcgatgcagggaaagcgaacgctgtactgactatcgggccgggaaaactcagcatggatagcagtgcaatgcctatacagcttactggcgaggccaaacagaaggatttaatcttttatgccgttttgcccgccatgctccgcggcagcctggcggatccgcagctcgcttttgcgccaggcgcattgctgcgttcacgcggacgggtgattgatgcgttagatattgatgaaattcgttggccgctggcgggcgtcagggtgacgcagcgcggcgtggatggtcggttacaggctattttacgggcgcatgaaaatgaaatgggcgatttcgttcttcatcttgatggtcttgcgaatgattttctccccgatgcagggcgctggcgctggcgctattgggggcaaggaagctttacgccaatgcacgcccgttgggatatcgccgggcagggcgaatggcgcgataacaccatccggctgaccagtctgtctaccggttttgatcggttgcaatatggcgcgatgactgtcacatcgccaagactgatcctggataaacccattgtctgggttcgtgacgacaaaacaccgtcgttacagggcgcgctgtctctggaggcgggaaaaaccatatttaccagcggaagcgtgctgccgccttctaccgttaattttagcgtcgaaggtcgcgaaccgaccctgttccagtttaaaggcgatcttcgggcgggggcgatagggccggtacggctgaatggacgctgggatggcgaacgccttcgcggacaggcctggtggccgaagcaatcgcttatcgtttttcagccgctgctcccgccggactggaaaatgacgctgcgcgaaggctcattgtatgcgcaggttgccttttccgcggcacaggggcaggggtttgaagcgggaggacacggcgtattaaaaggcggtaacgcctggatgccggataacaaaatcaacggcgtcgatttcatcctgccgtttcgcttccatcaaggcgcgtggcaattaggcacgcgtggccccgtctcgctgcgtattgccgagatagtaaaccaggtcacggcgaaaaatatcaccgccgatttacagggaggttatccctggagtgagtcgaatccattactgctaagcgatgtcagcgtagacgtgctgggcggtaaaatcattatgaaacagttgcggatgccgcagcacgatccggcgcttttacgggtgcagaatatctcatccagcgaattgattagcgccataaatccgaagcaattcgccatgtctggtccggtaagcggcgcgctgccgctgtggctgaacaatgaaaaatggataatcaaagatggctggcttaccaatccagggtcaatgacgttgcgtatcgataaaaatactgcggatgcggtggtaaaagataatgtcacggcaggctcggccattaactggctacgttatatggagattacgcattcatggacaaaaattaacgttgataacctgggcgtactcacgatgcaggcggccattaccggcaaaagccgcgtggatggtaaaaccgcgatcgttaatttgaactatacccatgaagaaaatgtgtttacgctgtggcgcagtttgcgttttggcgacaatttacaggcatggcttgaacaaaatacagcgttgccgcaacctccttgccggaaagacgaagactgtgaggataaataa

SEQ ID NO: 14814 - protein, 878 aa, Salmonella enterica subsp. arizonae serovar 62:z4,z23:--
MKGKYKAALALLLLLFLVPLTLLMTLGLWVPTLAGIWLPVGTRIALEESPRLTRHGVVIPDLRYLVNDCPLAHITQAELTHPSRWLLNIKSLELDAACLAKLPASEASPAAPRTLAQWQSMLPNTWINIDNVILAPWPEWQGKLAISMTPVVQQIRYQGEKVKFQGQLHGQALTVSQLEIAALANQPPVSLAGEFTLPLVPDGLPVSGHAAATLRLPQEPSLVDAELEWRDNAGQLIVMARGNPDPILDLPWAVTRQRLTISDGRWNWPYRGFPLSGRLAFNIDNWQAGLDNARVSGRLNILTHGDAGKANAVLTIGPGKLSMDSSAMPIQLTGEAKQKDLIFYAVLPAMLRGSLADPQLAFAPGALLRSRGRVIDALDIDEIRWPLAGVRVTQRGVDGRLQAILRAHENEMGDFVLHLDGLANDFLPDAGRWRWRYWGQGSFTPMHARWDIAGQGEWRDNTIRLTSLSTGFDRLQYGAMTVTSPRLILDKPIVWVRDDKTPSLQGALSLEAGKTIFTSGSVLPPSTVNFSVEGREPTLFQFKGDLRAGAIGPVRLNGRWDGERLRGQAWWPKQSLIVFQPLLPPDWKMTLREGSLYAQVAFSAAQGQGFEAGGHGVLKGGNAWMPDNKINGVDFILPFRFHQGAWQLGTRGPVSLRIAEIVNQVTAKNITADLQGGYPWSESNPLLLSDVSVDVLGGKIIMKQLRMPQHDPALLRVQNISSSELISAINPKQFAMSGPVSGALPLWLNNEKWIIKDGWLTNPGSMTLRIDKNTADAVVKDNVTAGSAINWLRYMEITHSWTKINVDNLGVLTMQAAITGKSRVDGKTAIVNLNYTHEENVFTLWRSLRFGDNLQAWLEQNTALPQPPCRKDEDCEDK

SEQ ID NO: 14815 - DNA, 2637 bp, Salmonella enterica subsp. enterica serovar Paratyphi B str. SPB7
  CDS (1)..(2637): transl_table=11
atgaagggtaaatataaagccgcccttgcgctactgttactgctgattcttatccctctgacgctactgatgaccctcgggctgtgggttcccactctggcgggaatttggctacccgtcggtacccgtatcgctctggaacaaagtccacgcctgacacgtcatgggttagtgattcccgatcttcgctatctggtcaatgattgttcgttagcgcatattacccaggcggaactgacgcatcccagccgttggttgctgaatattaaaagcctcaaactggatgccgcgtgcctggcgaaactgcccgctacggaagcttcccccgccgcgccgcgtacgctggcgcagtggcagtcaatgctgcccaatacctggattaacatcgataatgtcattctcgcgccctggccggaatggcagggcaagctggctatctccatgacgccggtcattcagcagatacgttatcagggcgaaaaagtaaaatttcaagggcagctacgcggtcaagcattgacggtgagccaactggagatcgccgcgctggccaaccagcctcccgttagcctggcgggggaatttgtgttgccgctggtaccggatggcctgccggtcagcggtcatgcggcagcgaccttgcgtctgccgcaggaaccgtcgctggtggatgcggaactggagtggcgtgataacgccggacagctcatcgtgatggcgcgaggtaatcctgacccgattctcgatctcccttgggcggtaacgcgtcagcggcttaccatcagcgatggccgctggaactggccatatcagggattccccttgagcggacgtctggcttttaatatagataactggcaagccgggccggataatgcgcgagtcagcggacgcctgaatattctgacccagggcgatgccggtaaagcgaacgcggtactgactatcggcccgggaaaactcagcatggatagcagtgagatgcctctacagcttaccggcgaggctaaacagaaggatttaatcttttatgccgtcttgcccgctatgttccgcggcagtctggtcgatccgcagctcacctttgcacctggcgcattgctacgctcgcgcggacgggtgattgatgcgttagatattgatgaaattcgttggccgctggcgggtgttaaggtgacgccgcgcggcgttgatggtcgattacaggctattttacgggcgcacgaaaatgagatgggcgatttcgttcttcatcttgatggcctggccaatgattttctccctgatgctggtcgctggcggtggcgctattgggggcaaggaagctttacgccaatgcgcgcccgctgggatattgccggacagggcgaatggcatgataacaccatcaggttgaccagtttgtccaccggttttgatcagttgcactatggcgcaatgaccgtcacatcgccaagactggcgctggataaacctattgtctgggttcgcgacgccacaacgccgtcgctacagggcgcgctgtctctggtggcggggaaaaccgtatttaccagtgggagcgtgctgccgccttctacccttaattttagcgttgaagggcgagagccaaccctgttccagtttaaaggcgaccttcgggcgggggcgatagggccggtacggctgaatgggcgctgggatggcgaacgccttcgtggacaggcctggtggccgaagcagtcgcttatcgtttttcagccgttgcttccaccggactggaaaatgacgctgcgcgaaggctcactgtatgcgcaggtggctttttccgccgcacaggggcaggggtttgaagccggtggacacggcgtgttaaaaggcggtagcgcctggatgccggataacaaaatcaacggcgtcgatttcattctgccatttcgcttccacaacggtgcgtggcaattggggacgcgcgggcccgtctcgctgcgtattgccgggatagtcaaccaggtcacggcgaaaaatatcaccgccgatttacagggtggttatccctggagcgagtcgaatccattactgctaagcgatgtcagcgtagacgtgctgggcggtcaaatcattatgaaacagttgcgaatgccgcagcacgacccggcgcttttacgggtgcaaaatatttcatccagcgaattgattagcgccataaatccaaagcaattcgccatgtctggtccggttagcggcgcgctgccgctgtggctgaacaatgaaaaatggataatcaaagatggctggcttacgaatcctgggccaatgacgttgcgtatcgataaagatactgcggatgcggtggtgaaggataatgtcacggcaggctcggcgatcaactggctacgttatatggagattacgcattcgtggacgaaaattaacgttgataacctgggcgtactaacgatgcaggcggctattaccggcaaaagccgggtagatggtaaaaccgcgatcgttaacttgaactatacccatgaagaaaatgtgtttacgctgtggcgcagtttgcgttttggcgacaatttacaggcatggcttgaacaaaatacagcgttgccgcaacctccttgccggaaagacaaggactgtgaggataaataa

SEQ ID NO: 14816 - protein, 878 aa, Salmonella enterica subsp. enterica serovar Paratyphi B str. SPB7
MKGKYKAALALLLLLILIPLTLLMTLGLWVPTLAGIWLPVGTRIALEQSPRLTRHGLVIPDLRYLVNDCSLAHITQAELTHPSRWLLNIKSLKLDAACLAKLPATEASPAAPRTLAQWQSMLPNTWINIDNVILAPWPEWQGKLAISMTPVIQQIRYQGEKVKFQGQLRGQALTVSQLEIAALANQPPVSLAGEFVLPLVPDGLPVSGHAAATLRLPQEPSLVDAELEWRDNAGQLIVMARGNPDPILDLPWAVTRQRLTISDGRWNWPYQGFPLSGRLAFNIDNWQAGPDNARVSGRLNILTQGDAGKANAVLTIGPGKLSMDSSEMPLQLTGEAKQKDLIFYAVLPAMFRGSLVDPQLTFAPGALLRSRGRVIDALDIDEIRWPLAGVKVTPRGVDGRLQAILRAHENEMGDFVLHLDGLANDFLPDAGRWRWRYWGQGSFTPMRARWDIAGQGEWHDNTIRLTSLSTGFDQLHYGAMTVTSPRLALDKPIVWVRDATTPSLQGALSLVAGKTVFTSGSVLPPSTLNFSVEGREPTLFQFKGDLRAGAIGPVRLNGRWDGERLRGQAWWPKQSLIVFQPLLPPDWKMTLREGSLYAQVAFSAAQGQGFEAGGHGVLKGGSAWMPDNKINGVDFILPFRFHNGAWQLGTRGPVSLRIAGIVNQVTAKNITADLQGGYPWSESNPLLLSDVSVDVLGGQIIMKQLRMPQHDPALLRVQNISSSELISAINPKQFAMSGPVSGALPLWLNNEKWIIKDGWLTNPGPMTLRIDKDTADAVVKDNVTAGSAINWLRYMEITHSWTKINVDNLGVLTMQAAITGKSRVDGKTAIVNLNYTHEENVFTLWRSLRFGDNLQAWLEQNTALPQPPCRKDKDCEDK

SEQ ID NO: 14817 - DNA, 2592 bp, Pectobacterium atrosepticum SCRI1043
  CDS (1)..(2592): transl_table=11
atgattaaaaaacaggcacttccaatcgcttttctgttggcagccttgctgtttctctcctggcgggcattgccacagtggctgccgcgccttgccgaaatctggctacctgcgggcctgtcgttgaccgtaaatgggtcgcctggctggcagggcggcgggctacatagcgcgggattcagtattacggctggggaatgcacgctatttgacgtacggaatatgacgttgcgctggcatagctggcgatggcatgccgatattgatgctgtgacgttaaacagcgactgcttgcagcatgtgccagcaggtaacagcactgaacctgcggtgcagctatcgcaatggcagcggcgactgcctgctgccactattcaggtaaagacatttacgctacagccttggcaggattatgccggacaggtgaggttcagtagcgatggcaaacaacaacaaacactcgattatcagggcgatcagttagcgtttagggcagagctaaatgatacacgcctgactctgcatgaaagcacgcttgccacgccagcaggatttgtgcgtttacaagtcagtggtgagatggagttggccgatacactggatgccgcaccggtgcgggggcggcttaccggcaagctggattcagggcagacgccggatccgctctcgctcctgttggattggcataagcagcaaggcgaactggtactgaatgcggcgaatgatgagacgccgctgatatcgctgccgtggcaactgacggatgacgttattcaggtcattaacggcgtctggcgctggccttatgcggatcagccactctcagggcaagtagccatgacattacagcactggcggcaagggctggatgccaccacgattaatgcgcggttgaatatgctgacgcaaggacataacggcaaggctaacgccgtgttggtgctggggccgggcaatatcggtttgctcaacagtgaattgcgctttcagcttaccggacaggctaacttaccggcgctctccctgacggcgacgctaccggggattttgcagggttctattctcaaccccgaactctctcttttaccgggcgcgctgctacgtgcctggggaacgcccgcaccacagatttatcttgaagaagcgcgttggccgctggctggcgttaggatcagtgcgacgggcgtgaatgggcggctacaggcgattgtgaaggcacgggaagcatactggggacgctttaacctgcaccttgacggtcaggcgcaggatttctggccggaccaaggtgagtggcaatggcgctattggggcagtggtcgcctgccgccgctgaaaggacagtgggacgtagcgggtcgaggtcgttggcaggatacgctgattgaagtgagccaactgtcgagtgggctggaccaactgggttatggcattgtgacggtacaccagcctcgcctgacgattactgagccgatccgttggcagcgcgcccgctcaggcgaacattttcaaggggcgttgcaactggcctccgagcgagcgcacttcagcaacggtggctatttaccgccttcattgttaacgctggaaatgcaggggcgcagcccaaatgatttccagctacaggggcagctacaggctgaagatattgggcccgttaggctgcgcggacgctgggatggtgagcgactgcgcggtggcgcatggtggccaatacagccgcttaaggtgtttcagcctctgctttccccgttgttgaaaatgaatatccgcaccggacagttttacgcacaggcggccttttccgctgcacgtaaagaagggttcagcgctggcggacattgggtggtgaaaaatggtgggctatggctacaggatggcgaagttagcggggtaaattttgttctcccttatcgcctgaaagatcaacgttggcaactgggcgtcaagcagcccgtcacgctgcgaatcgatgtattggataacctgtttaggatgaacaatatccgcgtcgatctacaagggttttatccgtacagtgagcgacgaccgctgattatgtctcaggctgatatggacgtattgaatgggcatgtcggcctgtccacgttgcgctggccgcagcgtgagccggcacttctcaccgttaagagtgtcgatctcagcgaactgatcactgtggtaaagcaaaagcagtttgcgctgtccgggcgtgtgagtggtacgcttccgctgaattttaatcatccgaccacgctgattgaaggtggacgaattaccaacgatggtttcctgacgctacgattggataaccaactggcagacgagttagcgagtaaaagtttggcgggcggtgcggcgattggttggttgcgctatctggagatcgggcgttcttatgccacgcttgacctgaataaccaaggtgagctgacattaacgtcgcgggtgcaggggaaaaatccgcagctcagcgcgaaacgacaggttattcttaactatcgccatcaggagaatatcttccaactatggcgcagtttgcgctttggcgataacttgcgggatacgctggaacagcaggcgaatgaataa

SEQ ID NO: 14818 - protein, 863 aa, Pectobacterium atrosepticum SCRI1043
MIKKQALPIAFLLAALLFLSWRALPQWLPRLAEIWLPAGLSLTVNGSPGWQGGGLHSAGFSITAGECTLFDVRNMTLRWHSWRWHADIDAVTLNSDCLQHVPAGNSTEPAVQLSQWQRRLPAATIQVKTFTLQPWQDYAGQVRFSSDGKQQQTLDYQGDQLAFRAELNDTRLTLHESTLATPAGFVRLQVSGEMELADTLDAAPVRGRLTGKLDSGQTPDPLSLLLDWHKQQGELVLNAANDETPLISLPWQLTDDVIQVINGVWRWPYADQPLSGQVAMTLQHWRQGLDATTINARLNMLTQGHNGKANAVLVLGPGNIGLLNSELRFQLTGQANLPALSLTATLPGILQGSILNPELSLLPGALLRAWGTPAPQIYLEEARWPLAGVRISATGVNGRLQAIVKAREAYWGRFNLHLDGQAQDFWPDQGEWQWRYWGSGRLPPLKGQWDVAGRGRWQDTLIEVSQLSSGLDQLGYGIVTVHQPRLTITEPIRWQRARSGEHFQGALQLASERAHFSNGGYLPPSLLTLEMQGRSPNDFQLQGQLQAEDIGPVRLRGRWDGERLRGGAWWPIQPLKVFQPLLSPLLKMNIRTGQFYAQAAFSAARKEGFSAGGHWVVKNGGLWLQDGEVSGVNFVLPYRLKDQRWQLGVKQPVTLRIDVLDNLFRMNNIRVDLQGFYPYSERRPLIMSQADMDVLNGHVGLSTLRWPQREPALLTVKSVDLSELITVVKQKQFALSGRVSGTLPLNFNHPTTLIEGGRITNDGFLTLRLDNQLADELASKSLAGGAAIGWLRYLEIGRSYATLDLNNQGELTLTSRVQGKNPQLSAKRQVILNYRHQENIFQLWRSLRFGDNLRDTLEQQANE

SEQ ID NO: 14819 - DNA, 2697 bp, Yersinia pseudotuberculosis IP 32953
  CDS (1)..(2697): transl_table=11
atggctaaatgcgcaaaaatagtagtcgggttgttattaataagcgcactgtcgctgctcgtgttatggaaaactctgccgacatggttaccgagagtcgccgggtattggttacctgcgggtagccaactgcaattacccgttcttcctgtgtggcgtaatggcgcgttgcgtgtcgagcaactgcgttatttggctcaggattgtacgctcgctaatatcagtcaactgagtataggttatcaccaaggacgctggcagttgggtgcgggtgatgtggtgctggagactgcttgtttgagtcagttaccgtctggcggtgatagctctccgctcgatttggcgcaatggcagcagcaactgtcccgttttgatcttactatcaatcatctgctggtcaccccttggcagcaatatgcaggcaagctgacactgacatcacctgacaacaataaatctcttcagacactcggttatcaggggcagcaactcagctttgctgtgacgttgaatgaacaacagcagcttagtttgaatcagttctctatggccattcccggtatgcctcaactgtttcagcttagcggtaaaattaaaatcccgttgtcattggatgagtggccagagcaaggcgcattagatgggctattgaccaccggttatttgtcgaagccgctgctattgaacttgagttggcagcaacagcagggcgtattgaccttaactgagcgtggcgataaccaacctttagcgcgtttaccctggcaagcctcggcgaatcttattcagatcgtgaacggtcagtggcaatggccatatggtcaacagccgttgaaggggggcgttaacctgacactacacgattgggatcaaggattggaacagacctcgattgatgcacggattaacgtgattacctcggggaaaaatggcaaagggaacgccgtattgacgctggggccgggcaatttgggtttaattaacagtgagttaaaattccaactaagtgggcaagtaaatctggaaaccatggtgtttaacgccacgatccccggtttacttagcggttcagtattgaatccgacgtggatattgtcccccggcgccttgctgcgtacttatggtaatctgaccccggaattgcggataaaagatgctcgttggccgctggcgggtatccgggtgaccgccgcgggtgttacggggcgtttacaggcaatcgttgatgctcaggatagctactgggggagtgtcaatctgcatctggatgggcaggcacaagcgttttggccagataagggcaattggcaatggcgctattgggggagcggaaacttgccaccattagcggcacgctgggatgtgggagggacggggagttggcgggatacgctgattacggtggatacgctgtcaacggggtttgatcgtttacaatatggcctagtcaaggtggacgcaccacgtttgatattgacgaaaccgctgacctggcaacgagataaccaccaccccgcgtttattgcaggtctgaaactgagcgctaaaaaagtggagttcagtgatggtggcggttatctccccccgtcagtgttatcactgcaattcaatggccgcgatctcgatagtttcctctggcaagggcaattgcaagctcagtctatcgggccaattccgctacgtggccgctgggatggtgagcgcttgcgtggtgagggttggtggcctaagcagtcattaatggtcttccagccactgatttcaaaagatctggggatcaaactgcgggacggtacgttttatgcgcaagccgcattctctgcggcgcgtgaacaagggtttactgccggtgggcattgggtggtaaacaatggcggcatgtggttgcaggacggtgagttaagcgggctagattttgtcatgtcgtatcgtttacagaaccatcactggcagttaggggctaaagagccggtaatgctacgtatcgcttcgttgaataacctctttgatatgcagaatattactgctgatttacaggggacttatccttattcagaaacggcaccactaacattaagcaatgttggcatggatattttgaacggccacctgagcttgtctgcgctgcgtttgccacaacatgatgccgccgtcctcaaattaagtcagattgatctgagcgcgttgttcaccgtattacaaccgaagcaatttgcgatgtcgggtaaagtgaacggcgaattaccgctttatcttaataacccacagtggctggtgcgtaatggttggattgccaatgacggcatgctgacattacggctcgataaagacctgaccgattctatcagtgagagcaatactgtcgccggtgcggcgattgactggttgcgttacatggagatttctcaatcgtataccaaagtggatctggataatctggggcagttgacgctaacctctaaagttcatggtgtgaattcgcaaaaaaatagcacacgggcggtagtactgaattaccagcacaaggagaacctgttccaactttggcgcagcctacgatttggtgacaatttacaagagtggttgcaacagactatttcattaccatcagcgagttcattaccgtccgcgagttcattaccgcaaggcatttcatcacaaccaacagcaccaataccgacgagggcgaaggaatga

SEQ ID NO: 14820 - protein, 898 aa, Yersinia pseudotuberculosis IP 32953
MAKCAKIVVGLLLISALSLLVLWKTLPTWLPRVAGYWLPAGSQLQLPVLPVWRNGALRVEQLRYLAQDCTLANISQLSIGYHQGRWQLGAGDVVLETACLSQLPSGGDSSPLDLAQWQQQLSRFDLTINHLLVTPWQQYAGKLTLTSPDNNKSLQTLGYQGQQLSFAVTLNEQQQLSLNQFSMAIPGMPQLFQLSGKIKIPLSLDEWPEQGALDGLLTTGYLSKPLLLNLSWQQQQGVLTLTERGDNQPLARLPWQASANLIQIVNGQWQWPYGQQPLKGGVNLTLHDWDQGLEQTSIDARINVITSGKNGKGNAVLTLGPGNLGLINSELKFQLSGQVNLETMVFNATIPGLLSGSVLNPTWILSPGALLRTYGNLTPELRIKDARWPLAGIRVTAAGVTGRLQAIVDAQDSYWGSVNLHLDGQAQAFWPDKGNWQWRYWGSGNLPPLAARWDVGGTGSWRDTLITVDTLSTGFDRLQYGLVKVDAPRLILTKPLTWQRDNHHPAFIAGLKLSAKKVEFSDGGGYLPPSVLSLQFNGRDLDSFLWQGQLQAQSIGPIPLRGRWDGERLRGEGWWPKQSLMVFQPLISKDLGIKLRDGTFYAQAAFSAAREQGFTAGGHWVVNNGGMWLQDGELSGLDFVMSYRLQNHHWQLGAKEPVMLRIASLNNLFDMQNITADLQGTYPYSETAPLTLSNVGMDILNGHLSLSALRLPQHDAAVLKLSQIDLSALFTVLQPKQFAMSGKVNGELPLYLNNPQWLVRNGWIANDGMLTLRLDKDLTDSISESNTVAGAAIDWLRYMEISQSYTKVDLDNLGQLTLTSKVHGVNSQKNSTRAVVLNYQHKENLFQLWRSLRFGDNLQEWLQQTISLPSASSLPSASSLPQGISSQPTAPIPTRAKE

SEQ ID NO: 14821 - DNA, 22 bp, Artificial sequence
  primer
atgctgggtaaatataaagccg

SEQ ID NO: 14822 - DNA, 27 bp, Artificial sequence
  primer
ttattgtttttcctcacactcttttcc

SEQ ID NO: 14823 - protein, 877 aa, Artificial sequence
  consensus sequence
  Variant (2)..(5): Xaa in position 2 to 5 is any amino acid
  Variant (7)..(10): Xaa in position 7 to 10 is any amino acid
  Variant (14)..(16): Xaa in position 14 to 16 is any amino acid
  Variant (18)..(19): Xaa in position 18 to 19 is any amino acid
  Variant (21)..(21): Xaa in position 21 is any amino acid
  Variant (23)..(24): Xaa in position 23 to 24 is any amino acid
  Variant (27)..(28): Xaa in position 27 to 28 is any amino acid
  Variant (30)..(30): Xaa in position 30 is any amino acid
  Variant (32)..(33): Xaa in position 32 to 33 is any amino acid
  Variant (36)..(36): Xaa in position 36 is any amino acid
  Variant (40)..(40): Xaa in position 40 is any amino acid
  Variant (42)..(45): Xaa in position 42 to 45 is any amino acid
  Variant (47)..(48): Xaa in position 47 to 48 is any amino acid
  Variant (49)..(49): Xaa in position 49 is any or no amino acid
  Variant (51)..(56): Xaa in position 51 to 56 is any amino acid
  Variant (58)..(61): Xaa in position 58 to 61 is any amino acid
  Variant (66)..(67): Xaa in position 66 to 67 is any amino acid
  Variant (70)..(70): Xaa in position 70 is any amino acid
  Variant (73)..(80): Xaa in position 73 to 80 is any amino acid
  Variant (81)..(87): Xaa in position 81 to 87 is any or no amino acid
  Variant (89)..(90): Xaa in position 89 to 90 is any amino acid
  Variant (93)..(93): Xaa in position 93 is any amino acid
  Variant (95)..(100): Xaa in position 95 to 100 is any amino acid
  Variant (102)..(103): Xaa in position 102 to 103 is any amino acid
  Variant (107)..(108): Xaa in position 107 to 108 is any amino acid
  Variant (111)..(114): Xaa in position 111 to 114 is any amino acid
  Variant (116)..(119): Xaa in position 116 to 119 is any amino acid
  Variant (120)..(121): Xaa in position 120 to 121 is any or no amino acid
  Variant (127)..(128): Xaa in position 127 to 128 is any amino acid
  Variant (131)..(135): Xaa in position 131 to 135 is any amino acid
  Variant (137)..(142): Xaa in position 137 to 142 is any amino acid
  Variant (145)..(148): Xaa in position 145 to 148 is any amino acid
  Variant (150)..(150): Xaa in position 150 is any amino acid
  Variant (152)..(159): Xaa in position 152 to 159 is any amino acid
  Variant (160)..(162): Xaa in position 160 to 162 is any or no amino acid
  Variant (164)..(166): Xaa in position 164 to 166 is any amino acid
  Variant (170)..(173): Xaa in position 170 to 173 is any amino acid
  Variant (175)..(177): Xaa in position 175 to 177 is any amino acid
  Variant (179)..(180): Xaa in position 179 to 180 is any amino acid
  Variant (182)..(182): Xaa in position 182 is any amino acid
  Variant (183)..(183): Xaa in position 183 is any or no amino acid
  Variant (185)..(199): Xaa in position 185 to 199 is any amino acid
  Variant (200)..(201): Xaa in position 200 to 201 is any or no amino acid
  Variant (203)..(203): Xaa in position 203 is any amino acid
  Variant (205)..(208): Xaa in position 205 to 208 is any amino acid
  Variant (211)..(212): Xaa in position 211 to 212 is any amino acid
  Variant (214)..(215): Xaa in position 214 to 215 is any amino acid
  Variant (217)..(218): Xaa in position 217 to 218 is any amino acid
  Variant (220)..(224): Xaa in position 220 to 224 is any amino acid
  Variant (226)..(228): Xaa in position 226 to 228 is any amino acid
  Variant (230)..(237): Xaa in position 230 to 237 is any amino acid
  Variant (239)..(239): Xaa in position 239 is any amino acid
  Variant (241)..(244): Xaa in position 241 to 244 is any amino acid
  Variant (246)..(246): Xaa in position 246 is any amino acid
  Variant (248)..(251): Xaa in position 248 to 251 is any amino acid
  Variant (253)..(256): Xaa in position 253 to 256 is any amino acid
  Variant (258)..(260): Xaa in position 258 to 260 is any amino acid
  Variant (264)..(274): Xaa in position 264 to 274 is any amino acid
  Variant (276)..(276): Xaa in position 276 is any amino acid
  Variant (278)..(278): Xaa in position 278 is any amino acid
  Variant (280)..(280): Xaa in position 280 is any amino acid
  Variant (282)..(284): Xaa in position 282 to 284 is any amino acid
  Variant (287)..(287): Xaa in position 287 is any amino acid
  Variant (289)..(296): Xaa in position 289 to 296 is any amino acid
  Variant (298)..(299): Xaa in position 298 to 299 is any amino acid
  Variant (301)..(308): Xaa in position 301 to 308 is any amino acid
  Variant (310)..(310): Xaa in position 310 is any amino acid
  Variant (312)..(313): Xaa in position 312 to 313 is any amino acid
  Variant (315)..(315): Xaa in position 315 is any amino acid
  Variant (317)..(318): Xaa in position 317 to 318 is any amino acid
  Variant (321)..(321): Xaa in position 321 is any amino acid
  Variant (326)..(327): Xaa in position 326 to 327 is any amino acid
  Variant (331)..(331): Xaa in position 331 is any amino acid
  Variant (333)..(336): Xaa in position 333 to 336 is any amino acid
  Variant (338)..(341): Xaa in position 338 to 341 is any amino acid
  Variant (344)..(344): Xaa in position 344 is any amino acid
  Variant (346)..(355): Xaa in position 346 to 355 is any amino acid
  Variant (357)..(357): Xaa in position 357 is any amino acid
  Variant (360)..(363): Xaa in position 360 to 363 is any amino acid
  Variant (366)..(368): Xaa in position 366 to 368 is any amino acid
  Variant (370)..(374): Xaa in position 370 to 374 is any amino acid
  Variant (381)..(382): Xaa in position 381 to 382 is any amino acid
  Variant (384)..(388): Xaa in position 384 to 388 is any amino acid
  Variant (390)..(390): Xaa in position 390 is any amino acid
  Variant (392)..(394): Xaa in position 392 to 394 is any amino acid
  Variant (401)..(402): Xaa in position 401 to 402 is any amino acid
  Variant (405)..(406): Xaa in position 405 to 406 is any amino acid
  Variant (409)..(409): Xaa in position 409 is any amino acid
  Variant (416)..(417): Xaa in position 416 to 417 is any amino acid
  Variant (419)..(423): Xaa in position 419 to 423 is any amino acid
  Variant (425)..(425): Xaa in position 425 is any amino acid
  Variant (427)..(427): Xaa in position 427 is any amino acid
  Variant (430)..(430): Xaa in position 430 is any amino acid
  Variant (433)..(433): Xaa in position 433 is any amino acid
  Variant (435)..(435): Xaa in position 435 is any amino acid
  Variant (438)..(438): Xaa in position 438 is any amino acid
  Variant (441)..(441): Xaa in position 441 is any amino acid
  Variant (443)..(443): Xaa in position 443 is any amino acid
  Variant (445)..(445): Xaa in position 445 is any amino acid
  Variant (451)..(451): Xaa in position 451 is any amino acid
  Variant (453)..(455): Xaa in position 453 to 455 is any amino acid
  Variant (457)..(458): Xaa in position 457 to 458 is any amino acid
  Variant (460)..(460): Xaa in position 460 is any amino acid
  Variant (463)..(464): Xaa in position 463 to 464 is any amino acid
  Variant (466)..(466): Xaa in position 466 is any amino acid
  Variant (468)..(468): Xaa in position 468 is any amino acid
  Variant (470)..(470): Xaa in position 470 is any amino acid
  Variant (472)..(473): Xaa in position 472 to 473 is any amino acid
  Variant (475)..(478): Xaa in position 475 to 478 is any amino acid
  Variant (485)..(485): Xaa in position 485 is any amino acid
  Variant (487)..(487): Xaa in position 487 is any amino acid
  Variant (490)..(492): Xaa in position 490 to 492 is any amino acid
  Variant (494)..(495): Xaa in position 494 to 495 is any amino acid
  Variant (499)..(499): Xaa in position 499 is any amino acid
  Variant (501)..(501): Xaa in position 501 is any amino acid
  Variant (504)..(505): Xaa in position 504 to 505 is any amino acid
  Variant (507)..(507): Xaa in position 507 is any amino acid
  Variant (510)..(512): Xaa in position 510 to 512 is any amino acid
  Variant (514)..(516): Xaa in position 514 to 516 is any amino acid
  Variant (518)..(518): Xaa in position 518 is any amino acid
  Variant (520)..(520): Xaa in position 520 is any amino acid
  Variant (522)..(522): Xaa in position 522 is any amino acid
  Variant (524)..(527): Xaa in position 524 to 527 is any amino acid
  Variant (529)..(530): Xaa in position 529 to 530 is any amino acid
  Variant (532)..(533): Xaa in position 532 to 533 is any amino acid
  Variant (534)..(534): Xaa in position 534 is any or no amino acid
  Variant (539)..(539): Xaa in position 539 is any amino acid
  Variant (541)..(545): Xaa in position 541 to 545 is any amino acid
  Variant (548)..(548): Xaa in position 548 is any amino acid
  Variant (550)..(551): Xaa in position 550 to 551 is any amino acid
  Variant (553)..(555): Xaa in position 553 to 555 is any amino acid
  Variant (557)..(557): Xaa in position 557 is any amino acid
  Variant (559)..(559): Xaa in position 559 is any amino acid
  Variant (561)..(562): Xaa in position 561 to 562 is any amino acid
  Variant (566)..(569): Xaa in position 566 to 569 is any amino acid
  Variant (575)..(575): Xaa in position 575 is any amino acid
  Variant (580)..(580): Xaa in position 580 is any amino acid
  Variant (589)..(589): Xaa in position 589 is any amino acid
  Variant (595)..(597): Xaa in position 595 to 597 is any amino acid
  Variant (599)..(602): Xaa in position 599 to 602 is any amino acid
  Variant (605)..(605): Xaa in position 605 is any amino acid
  Variant (607)..(608): Xaa in position 607 to 608 is any amino acid
  Variant (612)..(612): Xaa in position 612 is any amino acid
  Variant (618)..(619): Xaa in position 618 to 619 is any amino acid
  Variant (623)..(623): Xaa in position 623 is any amino acid
  Variant (628)..(628): Xaa in position 628 is any amino acid
  Variant (630)..(630): Xaa in position 630 is any amino acid
  Variant (632)..(632): Xaa in position 632 is any amino acid
  Variant (634)..(635): Xaa in position 634 to 635 is any amino acid
  Variant (637)..(638): Xaa in position 637 to 638 is any amino acid
  Variant (640)..(643): Xaa in position 640 to 643 is any amino acid
  Variant (645)..(645): Xaa in position 645 is any amino acid
  Variant (648)..(648): Xaa in position 648 is any amino acid
  Variant (651)..(651): Xaa in position 651 is any amino acid
  Variant (653)..(657): Xaa in position 653 to 657 is any amino acid
  Variant (659)..(659): Xaa in position 659 is any amino acid
  Variant (662)..(664): Xaa in position 662 to 664 is any amino acid
  Variant (667)..(667): Xaa in position 667 is any amino acid
  Variant (671)..(674): Xaa in position 671 to 674 is any amino acid
  Variant (676)..(680): Xaa in position 676 to 680 is any amino acid
  Variant (689)..(689): Xaa in position 689 is any amino acid
  Variant (692)..(693): Xaa in position 692 to 693 is any amino acid
  Variant (695)..(696): Xaa in position 695 to 696 is any amino acid
  Variant (699)..(699): Xaa in position 699 is any amino acid
  Variant (701)..(702): Xaa in position 701 to 702 is any amino acid
  Variant (704)..(705): Xaa in position 704 to 705 is any amino acid
  Variant (707)..(707): Xaa in position 707 is any amino acid
  Variant (709)..(709): Xaa in position 709 is any amino acid
  Variant (711)..(716): Xaa in position 711 to 716 is any amino acid
  Variant (719)..(719): Xaa in position 719 is any amino acid
  Variant (726)..(726): Xaa in position 726 is any amino acid
  Variant (728)..(734): Xaa in position 728 to 734 is any amino acid
  Variant (736)..(736): Xaa in position 736 is any amino acid
  Variant (738)..(742): Xaa in position 738 to 742 is any amino acid
  Variant (751)..(753): Xaa in position 751 to 753 is any amino acid
  Variant (755)..(755): Xaa in position 755 is any amino acid
  Variant (759)..(759): Xaa in position 759 is any amino acid
  Variant (763)..(764): Xaa in position 763 to 764 is any amino acid
  Variant (766)..(769): Xaa in position 766 to 769 is any amino acid
  Variant (772)..(773): Xaa in position 772 to 773 is any amino acid
  Variant (775)..(775): Xaa in position 775 is any amino acid
  Variant (777)..(778): Xaa in position 777 to 778 is any amino acid
  Variant (782)..(782): Xaa in position 782 is any amino acid
  Variant (786)..(787): Xaa in position 786 to 787 is any amino acid
  Variant (789)..(793): Xaa in position 789 to 793 is any amino acid
  Variant (795)..(796): Xaa in position 795 to 796 is any amino acid
  Variant (799)..(799): Xaa in position 799 is any amino acid
  Variant (802)..(802): Xaa in position 802 is any amino acid
  Variant (810)..(811): Xaa in position 810 to 811 is any amino acid
  Variant (813)..(813): Xaa in position 813 is any amino acid
  Variant (815)..(818): Xaa in position 815 to 818 is any amino acid
  Variant (823)..(823): Xaa in position 823 is any amino acid
  Variant (826)..(831): Xaa in position 826 to 831 is any amino acid
  Variant (833)..(842): Xaa in position 833 to 842 is any amino acid
  Variant (844)..(844): Xaa in position 844 is any amino acid
  Variant (848)..(848): Xaa in position 848 is any amino acid
  Variant (850)..(850): Xaa in position 850 is any amino acid
  Variant (853)..(853): Xaa in position 853 is any amino acid
  Variant (855)..(855): Xaa in position 855 is any amino acid
  Variant (868)..(868): Xaa in position 868 is any amino acid
  Variant (871)..(871): Xaa in position 871 is any amino acid
  Variant (873)..(875): Xaa in position 873 to 875 is any amino acid
MXXXXKXXXXLLLXXXLXXLXLXXTLXXWXPXXAGXWLPXGXXXXLXXXPXXXXXXLXXXXLRYLXXDCXLAXXXXXXXXXXXXXXXHXXRWXLXXXXXXLXXACLXXLPXXXXSXXXXXXLAQWQXXLPXXXXXIXXXXXXPWXXXXGXLXXXXXXXXXXXQXXXYQGXXXXFXXXLXXQXXLXXXXXXXXXXXXXXXXXLXGXXXXPLXXDXXPXXGXXXXXLXXXQXXXXXXXXLXWXXXXGXLXXXXRXXXXPXXXLPWXXXXXXXXXXXGXWXWXYXXXPLXGXXXXXXXXWXXGXXXXXXXXRXNXXTXGXXGKXNAVLXXGPGXLXXXXSXXXXQLXGXXXXXXXXXXAXLPXXXXGSXXXPXXXXXPGALLRXXGXXXXXLXIXXXRWPLAGXXVTXXGVXGRLQAIXXAXXXXXGXFXLHXDGXAXDFXPDXGXWXWRYWGXGXXXPXXAXWDXXGXGXWXDXXIXXXXLSTGFDXLXYGXXXVXXPRLXLXKPXXWXRDXXXPXXXGXLXLXAXXXXFXXGXXXLPPSXLXXXXXGRXPXXFXXXGXLXAXXIGPXXXXGRWDGXRLRGXAWWPKQSLXVFQPLXXXDXXXXLRXGXXYAQXAFSAAXXQGFXAGGHXVXKXGXXWXXDXXXXGXDFXLPXRXXXXXWXLGXXXPVXLRIXXXXNXXXXXNITADLQGXYPXXEXXPLXLXXVXXDXLXGXXXXXXLRXPQHDPAXLXXXXXXXSXLXXXXXPKQFAMSGXXXGXLPLXLNNXXWXXXXGWXXNXGXXTLRXDKDXXDXXXXXNXXAGXAIXWLRYMEIXXSXTXXXXDNLGXLTXXXXXXGXXXXXXXXXXVXLNYXHXENXFXLWRSLRFGDNLQXWLXQXXXLP

SEQ ID NO: 14824 - protein, 62 aa, Artificial sequence
  protein pattern
  Variant (6)..(6): Xaa in position 6 is any amino acid
  Variant (11)..(11): Xaa in position 11 is Glu, Asn or Gln
  Variant (12)..(12): Xaa in position 12 is Ala or Gly
  Variant (20)..(20): Xaa in position 20 is any amino acid
  Variant (26)..(26): Xaa in position 26 is Ile, Leu or Val
  Variant (27)..(27): Xaa in position 27 is Pro or Ser
  Variant (28)..(28): Xaa in position 28 is any amino acid
  Variant (30)..(30): Xaa in position 30 is any amino acid
  Variant (31)..(32): Xaa in position 31 to 32 is any or no amino acid
  Variant (34)..(35): Xaa in position 34 to 35 is any or no amino acid
  Variant (38)..(38): Xaa in position 38 is Asp or Glu
  Variant (40)..(40): Xaa in position 40 is Glu, Ser or Thr
  Variant (41)..(41): Xaa in position 41 is Phe or Leu
  Variant (45)..(45): Xaa in position 45 is Ala or Val
  Variant (51)..(51): Xaa in position 51 is any amino acid
  Variant (52)..(52): Xaa in position 52 is Glu or Gly
  Variant (56)..(56): Xaa in position 56 is any amino acid
  Variant (61)..(61): Xaa in position 61 is any amino acid
GRWDGXRLRGXXWWPKQSLXVFQPLXXXDXXXKXXLRXGXXYAQXAFSAAXXQGFXAGGHXV

SEQ ID NO: 14825 - protein, 61 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is any or no amino acid
  Variant (12)..(12): Xaa in position 12 is Ile or Val
  Variant (13)..(13): Xaa in position 13 is Lys or Arg
  Variant (16)..(17): Xaa in position 16 to 17 is any amino acid
  Variant (20)..(20): Xaa in position 20 is Asp or Thr
  Variant (27)..(27): Xaa in position 27 is Leu or Val
  Variant (28)..(28): Xaa in position 28 is Asp, Gln or Arg
  Variant (30)..(30): Xaa in position 30 is any amino acid
  Variant (31)..(31): Xaa in position 31 is Asp or Glu
  Variant (32)..(32): Xaa in position 32 is Asn, Gln or Ser
  Variant (33)..(34): Xaa in position 33 to 34 is any amino acid
  Variant (36)..(36): Xaa in position 36 is Asp or Ser
  Variant (37)..(37): Xaa in position 37 is Phe or Val
  Variant (38)..(38): Xaa in position 38 is Asn, Thr or Val
  Variant (41)..(41): Xaa in position 41 is Leu or Met
  Variant (44)..(44): Xaa in position 44 is any amino acid
  Variant (46)..(46): Xaa in position 46 is Asn, Gln or Ser
  Variant (47)..(47): Xaa in position 47 is Ala or Asp
  Variant (49)..(49): Xaa in position 49 is any amino acid
  Variant (52)..(52): Xaa in position 52 is any amino acid
  Variant (54)..(54): Xaa in position 54 is Asn or Arg
  Variant (56)..(56): Xaa in position 56 is Gln or Arg
IXDXXRWPLAGXXVTXXGVXGRLQAIXXAXXXXXGXXXLHXDGXAXXFXPDXGXWXWRYWG

SEQ ID NO: 14826 - protein, 58 aa, Artificial sequence
  protein pattern
  Variant (6)..(6): Xaa in position 6 is Ser or Thr
  Variant (7)..(7): Xaa in position 7 is any amino acid
  Variant (9)..(9): Xaa in position 9 is any amino acid
  Variant (11)..(11): Xaa in position 11 is Lys or Arg
  Variant (12)..(12): Xaa in position 12 is Ile, Leu or Val
  Variant (13)..(13): Xaa in position 13 is Asp or Asn
  Variant (14)..(14): Xaa in position 14 is Leu or Val
  Variant (19)..(19): Xaa in position 19 is any amino acid
  Variant (22)..(22): Xaa in position 22 is Leu or Met
  Variant (23)..(23): Xaa in position 23 is Gln or Thr
  Variant (24)..(24): Xaa in position 24 is Ala or Ser
  Variant (25)..(25): Xaa in position 25 is any amino acid
  Variant (26)..(26): Xaa in position 26 is Ile or Val
  Variant (27)..(27): Xaa in position 27 is any amino acid
  Variant (29)..(29): Xaa in position 29 is any amino acid
  Variant (30)..(30): Xaa in position 30 is Asn or Ser
  Variant (31)..(31): Xaa in position 31 is Arg or Ser
  Variant (32)..(32): Xaa in position 32 is any amino acid
  Variant (33)..(33): Xaa in position 33 is Asp, Glu or Lys
  Variant (34)..(34): Xaa in position 34 is Gly or Asn
  Variant (35)..(35): Xaa in position 35 is any amino acid
  Variant (36)..(36): Xaa in position 36 is Ser or Thr
  Variant (37)..(38): Xaa in position 37 to 38 is any amino acid
  Variant (40)..(40): Xaa in position 40 is Asn or Val
  Variant (44)..(44): Xaa in position 44 is any amino acid
  Variant (46)..(46): Xaa in position 46 is any amino acid
  Variant (49)..(49): Xaa in position 49 is Ile, Leu or Val
  Variant (51)..(51): Xaa in position 51 is Gln or Thr
RYMEIXXSXTXXXXDNLGXLTXXXXXXGXXXXXXXXXXVXLNYXHXENXFXLWRSLRF

SEQ ID NO: 14827 - protein, 60 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is Gly or Asn
  Variant (7)..(7): Xaa in position 7 is any amino acid
  Variant (8)..(8): Xaa in position 8 is Ile, Leu or Val
  Variant (9)..(9): Xaa in position 9 is Asn or Ser
  Variant (11)..(11): Xaa in position 11 is Ala, Leu or Val
  Variant (14)..(14): Xaa in position 14 is Ile or Val
  Variant (15)..(15): Xaa in position 15 is Leu or Met
  Variant (16)..(16): Xaa in position 16 is Pro or Ser
  Variant (17)..(17): Xaa in position 17 is Phe or Tyr
  Variant (19)..(19): Xaa in position 19 is Phe or Leu
  Variant (20)..(20): Xaa in position 20 is any amino acid
  Variant (21)..(21): Xaa in position 21 is Asp, Asn or Gln
  Variant (22)..(23): Xaa in position 22 to 23 is any amino acid
  Variant (25)..(25): Xaa in position 25 is any amino acid
  Variant (28)..(28): Xaa in position 28 is any amino acid
  Variant (29)..(29): Xaa in position 29 is Lys or Arg
  Variant (30)..(30): Xaa in position 30 is any amino acid
  Variant (33)..(33): Xaa in position 33 is any amino acid
  Variant (37)..(37): Xaa in position 37 is Ala, Asp or Gly
  Variant (38)..(38): Xaa in position 38 is Glu, Gly or Ser
  Variant (39)..(39): Xaa in position 39 is Ile, Leu or Val
  Variant (40)..(40): Xaa in position 40 is any amino acid
  Variant (42)..(42): Xaa in position 42 is any amino acid
  Variant (43)..(43): Xaa in position 43 is Phe or Val
  Variant (44)..(44): Xaa in position 44 is Asp or Thr
  Variant (45)..(46): Xaa in position 45 to 46 is any amino acid
  Variant (48)..(48): Xaa in position 48 is Ile or Leu
  Variant (55)..(55): Xaa in position 55 is any amino acid
  Variant (56)..(56): Xaa in position 56 is Trp or Tyr
  Variant (58)..(58): Xaa in position 58 is Trp or Tyr
  Variant (59)..(59): Xaa in position 59 is Ser or Thr
MXXXDXXXXGXDFXXXXRXXXXXWXLGXXXPVXLRIXXXXNXXXXXNXTADLQGXXPXXE

SEQ ID NO: 14828 - protein, 60 aa, Artificial sequence
  protein pattern
  Variant (9)..(9): Xaa in position 9 is any amino acid
  Variant (10)..(10): Xaa in position 10 is Phe or Val
  Variant (11)..(11): Xaa in position 11 is any amino acid
  Variant (13)..(13): Xaa in position 13 is Ala or Glu
  Variant (16)..(16): Xaa in position 16 is Phe or Leu
  Variant (17)..(17): Xaa in position 17 is Trp or Tyr
  Variant (19)..(19): Xaa in position 19 is Asp or Asn
  Variant (21)..(21): Xaa in position 21 is Glu or Pro
  Variant (22)..(22): Xaa in position 22 is any amino acid
  Variant (24)..(24): Xaa in position 24 is Ile or Leu
  Variant (25)..(25): Xaa in position 25 is Ile or Val
  Variant (26)..(26): Xaa in position 26 is Lys or Arg
  Variant (27)..(27): Xaa in position 27 is Asp or Asn
  Variant (30)..(30): Xaa in position 30 is Ile or Leu
  Variant (31)..(31): Xaa in position 31 is Ala or Thr
  Variant (33)..(33): Xaa in position 33 is Ala, Asp, Pro or Ser
  Variant (35)..(35): Xaa in position 35 is any amino acid
  Variant (36)..(36): Xaa in position 36 is Leu or Met
  Variant (40)..(40): Xaa in position 40 is Ile or Leu
  Variant (42)..(42): Xaa in position 42 is any amino acid
  Variant (43)..(43): Xaa in position 43 is Asp or Asn
  Variant (44)..(44): Xaa in position 44 is any amino acid
  Variant (45)..(45): Xaa in position 45 is Ala or Thr
  Variant (47)..(47): Xaa in position 47 is Ala or Ser
  Variant (48)..(48): Xaa in position 48 is Ile or Val
  Variant (49)..(49): Xaa in position 49 is Ala, Ser or Val
  Variant (50)..(50): Xaa in position 50 is Glu or Lys
  Variant (51)..(51): Xaa in position 51 is Asp or Ser
  Variant (53)..(53): Xaa in position 53 is any amino acid
  Variant (54)..(54): Xaa in position 54 is Thr or Val
  Variant (57)..(57): Xaa in position 57 is Ala, Ser or Thr
  Variant (60)..(60): Xaa in position 60 is Asp or Asn
PKQFAMSGXXXGXLPXXLXNXXWXXXXGWXXNXGXXTLRXDXXXXDXXXXXNXXAGXAIX

SEQ ID NO: 14829 - protein, 60 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any amino acid
  Variant (9)..(9): Xaa in position 9 is Ile or Val
  Variant (10)..(10): Xaa in position 10 is Ala, Gly or Val
  Variant (12)..(12): Xaa in position 12 is any amino acid
  Variant (14)..(14): Xaa in position 14 is Glu, Arg or Ser
  Variant (16)..(16): Xaa in position 16 is His or Arg
  Variant (18)..(18): Xaa in position 18 is any or no amino acid
  Variant (20)..(20): Xaa in position 20 is any or no amino acid
  Variant (22)..(22): Xaa in position 22 is any amino acid
  Variant (23)..(23): Xaa in position 23 is Leu or Val
  Variant (24)..(24): Xaa in position 24 is Asp, Asn or Thr
  Variant (25)..(25): Xaa in position 25 is Asp, Glu, Ser or Thr
  Variant (26)..(26): Xaa in position 26 is Leu or Met
  Variant (27)..(27): Xaa in position 27 is Ser or Thr
  Variant (31)..(31): Xaa in position 31 is Asp or Asn
  Variant (32)..(32): Xaa in position 32 is any amino acid
  Variant (33)..(33): Xaa in position 33 is Ile or Leu
  Variant (34)..(34): Xaa in position 34 is any amino acid
  Variant (35)..(35): Xaa in position 35 is His or Tyr
  Variant (37)..(37): Xaa in position 37 is any amino acid
  Variant (38)..(38): Xaa in position 38 is Ile, Met or Val
  Variant (39)..(39): Xaa in position 39 is any amino acid
  Variant (41)..(41): Xaa in position 41 is Asp, Glu or Thr
  Variant (42)..(42): Xaa in position 42 is any amino acid
  Variant (46)..(46): Xaa in position 46 is any amino acid
  Variant (48)..(48): Xaa in position 48 is Asp, Asn or Thr
  Variant (51)..(51): Xaa in position 51 is Ile, Leu or Val
  Variant (52)..(52): Xaa in position 52 is any amino acid
  Variant (54)..(54): Xaa in position 54 is any amino acid
  Variant (56)..(56): Xaa in position 56 is Asp or Ser
  Variant (57)..(57): Xaa in position 57 is Ala, Asp, Glu or Asn
  Variant (58)..(59): Xaa in position 58 to 59 is any amino acid
PXXXAXWDXXGXGXWXDXTXIXXXXXXTGFXXXXXGXXXVXXPRLXLXKPXXWXRXXXXP

SEQ ID NO: 14830 - protein, 62 aa, Artificial sequence
  protein pattern
  Variant (2)..(8): Xaa in position 2 to 8 is any amino acid
  Variant (9)..(10): Xaa in position 9 to 10 is any or no amino acid
  Variant (12)..(12): Xaa in position 12 is any amino acid
  Variant (13)..(14): Xaa in position 13 to 14 is any or no amino acid
  Variant (16)..(16): Xaa in position 16 is Ile or Leu
  Variant (17)..(17): Xaa in position 17 is Asn or Ser
  Variant (18)..(18): Xaa in position 18 is Ile or Val
  Variant (19)..(19): Xaa in position 19 is Ile or Leu
  Variant (21)..(21): Xaa in position 21 is any amino acid
  Variant (23)..(23): Xaa in position 23 is any amino acid
  Variant (24)..(24): Xaa in position 24 is Ala or Asn
  Variant (27)..(27): Xaa in position 27 is Ala or Gly
  Variant (32)..(32): Xaa in position 32 is Asn or Thr
  Variant (33)..(33): Xaa in position 33 is Phe, Ile or Leu
  Variant (37)..(37): Xaa in position 37 is any amino acid
  Variant (39)..(39): Xaa in position 39 is Gly or Ser
  Variant (40)..(40): Xaa in position 40 is Leu or Met
  Variant (41)..(41): Xaa in position 41 is any amino acid
  Variant (42)..(42): Xaa in position 42 is Asn or Ser
  Variant (44)..(44): Xaa in position 44 is Ala, Asp, Glu or Gln
  Variant (45)..(45): Xaa in position 45 is Leu or Met
  Variant (46)..(46): Xaa in position 46 is any amino acid
  Variant (47)..(47): Xaa in position 47 is Phe, Ile or Leu
  Variant (48)..(48): Xaa in position 48 is Gln or Arg
  Variant (50)..(50): Xaa in position 50 is Ser or Thr
  Variant (52)..(52): Xaa in position 52 is Glu or Gln
  Variant (53)..(53): Xaa in position 53 is Ala or Val
  Variant (54)..(56): Xaa in position 54 to 56 is any amino acid
  Variant (57)..(57): Xaa in position 57 is Asp, Glu or Thr
  Variant (58)..(58): Xaa in position 58 is Leu or Met
  Variant (59)..(59): Xaa in position 59 is Ile or Val
  Variant (60)..(60): Xaa in position 60 is Phe or Leu
  Variant (61)..(61): Xaa in position 61 is any amino acid
WXXXXXXXXXSXXXRXXXXTXGXXGKXNAVLXXGPGXLXXXXSXXXXXLXGXXXXXXXXXXA

SEQ ID NO: 14831 - protein, 40 aa, Artificial sequence
  protein pattern
  Variant (2)..(2): Xaa in position 2 is Gly or Ser
  Variant (3)..(3): Xaa in position 3 is any amino acid
  Variant (6)..(6): Xaa in position 6 is Ala or Pro
  Variant (8)..(8): Xaa in position 8 is Thr or Val
  Variant (10)..(10): Xaa in position 10 is any amino acid
  Variant (11)..(12): Xaa in position 11 to 12 is any or no amino acid
  Variant (14)..(14): Xaa in position 14 is any amino acid
  Variant (15)..(16): Xaa in position 15 to 16 is any or no amino acid
  Variant (18)..(18): Xaa in position 18 is any amino acid
  Variant (19)..(19): Xaa in position 19 is Asp, Glu or Asn
  Variant (20)..(20): Xaa in position 20 is Leu or Pro
  Variant (21)..(21): Xaa in position 21 is Asp or Thr
  Variant (22)..(22): Xaa in position 22 is any amino acid
  Variant (24)..(24): Xaa in position 24 is any amino acid
  Variant (25)..(25): Xaa in position 25 is Phe or Trp
  Variant (26)..(26): Xaa in position 26 is any amino acid
  Variant (28)..(28): Xaa in position 28 is Ala, Asp, Asn or Gln
  Variant (30)..(30): Xaa in position 30 is any amino acid
  Variant (32)..(32): Xaa in position 32 is Asp, Glu, Gly or Gln
  Variant (33)..(33): Xaa in position 33 is Ala, Asp, Glu or Ser
  Variant (37)..(37): Xaa in position 37 is Ile or Val
  Variant (38)..(38): Xaa in position 38 is any amino acid
  Variant (39)..(39): Xaa in position 39 is Leu or Val
  Variant (40)..(40): Xaa in position 40 is Asn, Arg or Ser
GXXLPXSXLXXXFXXXGXXXXXFXXXGXLXAXXIGPXXXX

SEQ ID NO: 14832 - protein, 23 aa, Artificial sequence
  protein pattern
  Variant (2)..(2): Xaa in position 2 is any amino acid
  Variant (3)..(3): Xaa in position 3 is Met or Val
  Variant (4)..(4): Xaa in position 4 is Asp or Glu
  Variant (5)..(5): Xaa in position 5 is Ala, Ile or Val
  Variant (7)..(7): Xaa in position 7 is Gly or Asn
  Variant (9)..(9): Xaa in position 9 is any amino acid
  Variant (10)..(10): Xaa in position 10 is Ile, Leu or Val
  Variant (11)..(11): Xaa in position 11 is any amino acid
  Variant (12)..(12): Xaa in position 12 is Leu or Met
  Variant (13)..(13): Xaa in position 13 is any amino acid
  Variant (14)..(14): Xaa in position 14 is Ala or Gln
  Variant (17)..(17): Xaa in position 17 is Leu or Met
  Variant (22)..(22): Xaa in position 22 is Ala or Pro
VXXXXLXGXXXXXXLRXPQHDXA

SEQ ID NO: 14833 - protein, 28 aa, Artificial sequence
  protein pattern
  Variant (2)..(2): Xaa in position 2 is any amino acid
  Variant (3)..(3): Xaa in position 3 is Ile or Val
  Variant (4)..(4): Xaa in position 4 is Glu or Pro
  Variant (5)..(5): Xaa in position 5 is Asp or Gln
  Variant (10)..(10): Xaa in position 10 is Ala or Val
  Variant (11)..(11): Xaa in position 11 is Glu, Gly, Asn or Gln
  Variant (12)..(12): Xaa in position 12 is Asp or Glu
  Variant (14)..(14): Xaa in position 14 is any amino acid
  Variant (15)..(22): Xaa in position 15 to 22 is any or no amino acid
  Variant (24)..(24): Xaa in position 24 is Ala or Ser
  Variant (25)..(25): Xaa in position 25 is any amino acid
  Variant (26)..(26): Xaa in position 26 is Ile or Pro
  Variant (27)..(27): Xaa in position 27 is Ser or Thr
  Variant (28)..(28): Xaa in position 28 is Gln or Arg
LXXXXLRYLXXXCXXXXXXXXXLXXXXX

SEQ ID NO: 14834 - protein, 49 aa, Artificial sequence
  protein pattern
  Variant (2)..(3): Xaa in position 2 to 3 is any amino acid
  Variant (4)..(4): Xaa in position 4 is any or no amino acid
  Variant (6)..(7): Xaa in position 6 to 7 is any amino acid
  Variant (8)..(10): Xaa in position 8 to 10 is any or no amino acid
  Variant (12)..(12): Xaa in position 12 is Asp or Gly
  Variant (13)..(13): Xaa in position 13 is Asp or Asn
  Variant (14)..(14): Xaa in position 14 is Gly, Asn or Pro
  Variant (15)..(15): Xaa in position 15 is Asp or Gln
  Variant (17)..(17): Xaa in position 17 is Ile or Leu
  Variant (18)..(18): Xaa in position 18 is Ala or Leu
  Variant (19)..(19): Xaa in position 19 is Asp or Arg
  Variant (23)..(23): Xaa in position 23 is Ala or Gln
  Variant (24)..(24): Xaa in position 24 is Ala, Ile or Val
  Variant (25)..(25): Xaa in position 25 is Ser or Thr
  Variant (26)..(26): Xaa in position 26 is any amino acid
  Variant (27)..(27): Xaa in position 27 is Asn or Gln
  Variant (28)..(28): Xaa in position 28 is any amino acid
  Variant (29)..(29): Xaa in position 29 is Ile or Leu
  Variant (30)..(30): Xaa in position 30 is Gln or Thr
  Variant (31)..(31): Xaa in position 31 is Ile or Val
  Variant (32)..(32): Xaa in position 32 is Ser or Val
  Variant (33)..(33): Xaa in position 33 is Asp or Asn
  Variant (35)..(35): Xaa in position 35 is Gln or Arg
  Variant (37)..(37): Xaa in position 37 is Asn, Gln or Ser
  Variant (39)..(41): Xaa in position 39 to 41 is any amino acid
  Variant (42)..(42): Xaa in position 42 is Gly or Gln
  Variant (43)..(43): Xaa in position 43 is any amino acid
  Variant (45)..(45): Xaa in position 45 is Leu or Met
  Variant (46)..(46): Xaa in position 46 is any amino acid
  Variant (48)..(48): Xaa in position 48 is any amino acid
  Variant (49)..(49): Xaa in position 49 is Leu or Val
QXXXVXXXXXRXXXXPXXXLPWXXXXXXXXXXXGXWXWXXXXXPXXGXX

SEQ ID NO: 14835 - protein, 39 aa, Artificial sequence
  protein pattern
  Variant (2)..(3): Xaa in position 2 to 3 is any amino acid
  Variant (4)..(6): Xaa in position 4 to 6 is any or no amino acid
  Variant (12)..(12): Xaa in position 12 is Ala, Gln or Ser
  Variant (13)..(13): Xaa in position 13 is any amino acid
  Variant (15)..(15): Xaa in position 15 is Pro or Ser
  Variant (16)..(16): Xaa in position 16 is Asn or Arg
  Variant (17)..(18): Xaa in position 17 to 18 is any amino acid
  Variant (19)..(19): Xaa in position 19 is Ile or Leu
  Variant (20)..(20): Xaa in position 20 is Asn or Thr
  Variant (22)..(23): Xaa in position 22 to 23 is any amino acid
  Variant (24)..(24): Xaa in position 24 is Phe, Leu or Val
  Variant (25)..(25): Xaa in position 25 is any amino acid
  Variant (26)..(26): Xaa in position 26 is Phe, Leu or Val
  Variant (27)..(27): Xaa in position 27 is Ala, Ser or Thr
  Variant (30)..(30): Xaa in position 30 is Pro or Gln
  Variant (31)..(31): Xaa in position 31 is Glu or Gln
  Variant (32)..(32): Xaa in position 32 is Trp or Tyr
  Variant (33)..(33): Xaa in position 33 is Ala, Glu or Gln
  Variant (35)..(35): Xaa in position 35 is Glu or Lys
  Variant (37)..(37): Xaa in position 37 is any amino acid
  Variant (38)..(38): Xaa in position 38 is Ala, Ile or Leu
  Variant (39)..(39): Xaa in position 39 is Ala, Ser or Thr
PXXXXXLAQWQXXLXXXXXXIXXXXXXPWXXXXGXLXXX

SEQ ID NO: 14836 - protein, 25 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Leu or Val
  Variant (7)..(7): Xaa in position 7 is any amino acid
  Variant (8)..(8): Xaa in position 8 is Leu or Val
  Variant (11)..(11): Xaa in position 11 is any amino acid
  Variant (15)..(15): Xaa in position 15 is Ala, Leu or Val
  Variant (17)..(17): Xaa in position 17 is Ser or Thr
  Variant (18)..(18): Xaa in position 18 is Gln or Arg
  Variant (19)..(19): Xaa in position 19 is Ile or Leu
  Variant (20)..(20): Xaa in position 20 is Ala, Gln or Ser
  Variant (21)..(21): Xaa in position 21 is Phe or Leu
  Variant (22)..(22): Xaa in position 22 is Asp, Glu, Pro or Gln
  Variant (23)..(24): Xaa in position 23 to 24 is any amino acid
LXXWXPXXAGXWLPXGXXXXXXXXP

SEQ ID NO: 14837 - protein, 30 aa, Artificial sequence
  protein pattern
  Variant (2)..(2): Xaa in position 2 is Ala or Gly
  Variant (3)..(3): Xaa in position 3 is any amino acid
  Variant (4)..(4): Xaa in position 4 is Phe or Leu
  Variant (5)..(5): Xaa in position 5 is Gln, Arg or Ser
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (13)..(13): Xaa in position 13 is Glu, Gln or Thr
  Variant (14)..(15): Xaa in position 14 to 15 is any amino acid
  Variant (16)..(16): Xaa in position 16 is Phe or Leu
  Variant (17)..(17): Xaa in position 17 is any amino acid
  Variant (24)..(24): Xaa in position 24 is Ala, Ser or Thr
  Variant (25)..(25): Xaa in position 25 is any amino acid
  Variant (27)..(27): Xaa in position 27 is any amino acid
  Variant (28)..(28): Xaa in position 28 is Leu, Pro or Val
  Variant (29)..(29): Xaa in position 29 is any amino acid
  Variant (30)..(30): Xaa in position 30 is Asp or Pro
PXXXXGSXLXXPXXXXXPGALLRXXGXXXX

SEQ ID NO: 14838 - protein, 27 aa, Artificial sequence
  protein pattern
  Variant (2)..(5): Xaa in position 2 to 5 is any amino acid
  Variant (6)..(6): Xaa in position 6 is any or no amino acid
  Variant (8)..(8): Xaa in position 8 is any or no amino acid
  Variant (10)..(10): Xaa in position 10 is Leu or Met
  Variant (12)..(16): Xaa in position 12 to 16 is any amino acid
  Variant (17)..(17): Xaa in position 17 is Ala, Gln, Ser or Thr
  Variant (18)..(18): Xaa in position 18 is Ala or Gly
  Variant (19)..(19): Xaa in position 19 is any amino acid
  Variant (20)..(20): Xaa in position 20 is Phe, Ile or Leu
  Variant (21)..(21): Xaa in position 21 is any amino acid
  Variant (22)..(22): Xaa in position 22 is Phe, Ile or Leu
  Variant (24)..(24): Xaa in position 24 is any amino acid
  Variant (25)..(25): Xaa in position 25 is Glu, Ser or Thr
  Variant (26)..(26): Xaa in position 26 is Ala, Leu or Pro
  Variant (27)..(27): Xaa in position 27 is Asp, Glu or Ser
FXXXXXPXGXPXXXXXXXXXXXPXXXX

SEQ ID NO: 14839 - DNA, 1644 bp, ESCHERICHIA COLI
  CDS (1)..(1644): transl_table=11
atgttgaggcacatcttaacggcgaaaaatcttttgtcaaacccgatttttaaattccccaactgtttgccgtttctatcaacagtttgttgcatttgcagacaatttgttggcgaaaatctttgcagctttgctgattctccctcattatttgaaatgtggtttcactttctgcaattaaggtcggctttgaatatctcctctgctttacgccaggttgttcacggcactcgctggcacgctaaacgcaagagctacaaagtgttgttctggcgcgagataaccccgcttgctgttcctatcttcatggagaatgcctgtgtcctgttgatgggggttctgagcacttttctggtcagctggctgggaaaagatgcgatggccggcgtgggattggcggacagcttcaatatggtcattatggctttttttgctgctatcgatcttggtactactgtcgttgtggcatttagtctcggtaagcgggatcgacgacgagcgagggtggcgacgcggcagtcattggtgatcatgacgttgtttgccgtactgttggcaacgcttattcatcattttggcgaacaaattattgatttcgtcgcgggtgatgccacgacagaagttaaagcactggcgttgacttatctggagctgacggtactcagttatccagcagctgccatcactcttattggtagcggggcacttcgtggtgcagggaatacgaaaataccgctattgattaacggtagcctgaatattcttaatattattattagcggcatattgatttacggccttttctcctggccgggactgggatttgtcggggcagggctgggtttaaccatttctcgttatattggcgcagttgcaattttgtgggtgctggcgattggttttaatcctgcgctaaggatttcgttaaagagctattttaaaccgctgaattttagcattatctgggaagtcatggggattggtattcccgcgagtgtcgaatcagtgttatttaccagtggtcggttattaacccaaatgttcgttgccgggatggggaccagtgttattgccggaaattttatcgcgttttcaattgcggctcttatcaacttacccggaagtgcgctcggctctgcttctacgatcattacaggccgaaggttgggggtagggcagatagcgcaagcagagattcagttgcggcatgtgttctggctttccactcttggattaacggccatcgcctggctaacggctccctttgccggggttatggcatcgttttacacccaggatccacaggttaaacatgtcgttgtgattctgatttggctaaatgctttatttatgcctatttggtccgcctcatgggtgctacccgctggatttaaaggtgctcgtgatgcccgttacgccatgtgggtttcgatgttgagcatgtggggttgtcgggttgtagtcggttatgtgctgggaatcatgcttggctggggtgtggttggtgtctggatgggaatgtttgccgactgggctgtgcgggccgtgctgttttactggcgaatggttactggacgttggctatggaaataccctcgacccgagccgcaaaagtgtgaaaaaaagccagttgtgtcggaataa

SEQ ID NO: 14840 - protein, 547 aa, ESCHERICHIA COLI
MLRHILTAKNLLSNPIFKFPNCLPFLSTVCCICRQFVGENLCSFADSPSLFEMWFHFLQLRSALNISSALRQVVHGTRWHAKRKSYKVLFWREITPLAVPIFMENACVLLMGVLSTFLVSWLGKDAMAGVGLADSFNMVIMAFFAAIDLGTTVVVAFSLGKRDRRRARVATRQSLVIMTLFAVLLATLIHHFGEQIIDFVAGDATTEVKALALTYLELTVLSYPAAAITLIGSGALRGAGNTKIPLLINGSLNILNIIISGILIYGLFSWPGLGFVGAGLGLTISRYIGAVAILWVLAIGFNPALRISLKSYFKPLNFSIIWEVMGIGIPASVESVLFTSGRLLTQMFVAGMGTSVIAGNFIAFSIAALINLPGSALGSASTIITGRRLGVGQIAQAEIQLRHVFWLSTLGLTAIAWLTAPFAGVMASFYTQDPQVKHVVVILIWLNALFMPIWSASWVLPAGFKGARDARYAMWVSMLSMWGCRVVVGYVLGIMLGWGVVGVWMGMFADWAVRAVLFYWRMVTGRWLWKYPRPEPQKCEKKPVVSE

SEQ ID NO: 14841 - DNA, 1458 bp, Salmonella enterica subsp. enterica serovar Typhi str. CT18
  CDS (1)..(1458): transl_table=11
atgtggtttcaactctcttctttaaggtccattttgaacgtctccactgccttacgccaggttgtcgtccgtacgccctggtatgccaaacgcaagagctacaaagtgttgttctggcgtgaaatcaccccacttgctatccccatttttctggaaaatacctgtgttttgctaatgggcgtgctcagtacttttctcgtcagttggttgggcaaggaagcaatggcgggcgtggggcttgccgacagttttaatatggtaattatggctttttttgcggctatcgatcttggtactacggtggtggtcgcctttagcctcggcaagcgcgataggcgacgggcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtactgagttatccggctgcggcaattgcgctaatcggtagcggcgcgctgcgtggggcagggaatacgaaaatcccgttgatgattaacggcgggatgaacattctcaatattgtcatcagcagcatcctgatttacggggctttctcctggcaagggctgggttttgccggtgcggggctgggattaaccatttcgcgctacatcggcgcggtagcgattatttgggtgctgatgattggttttaatccggcgctgcgcattccgctgaaaagctatctgaagccgttgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaatctgccgggtaacgcccttggttcggcgtcgactattatcaccggtaagcgtcttggtaccgggcaaattggtcaggcagagcgtcaattgcgccatgtattctggatgtcgactatcgtacttacggcaatcgcctggggaacagcgccgttcgcgggtctgtttgcctcattttatacccaggagcaggacgtaaaagaggtagtgaaagttctgctctggcttaatgctgcctttatgccaatttgggctgccgcgtgggtgctgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacctgcgcgtaaagagggagtaa

SEQ ID NO: 14842 - protein, 485 aa, Salmonella enterica subsp. enterica serovar Typhi str. CT18
MWFQLSSLRSILNVSTALRQVVVRTPWYAKRKSYKVLFWREITPLAIPIFLENTCVLLMGVLSTFLVSWLGKEAMAGVGLADSFNMVIMAFFAAIDLGTTVVVAFSLGKRDRRRARAAARQSLVIMTLFAVVLAVVIHYFGSEIINIVAGEATPEVKGLALTYLELTVLSYPAAAIALIGSGALRGAGNTKIPLMINGGMNILNIVISSILIYGAFSWQGLGFAGAGLGLTISRYIGAVAIIWVLMIGFNPALRIPLKSYLKPLNFGIIWEVMGIGIPASIESVLFNGGKLLTQMFVAGMGTNVIAGNFIAFSVAALINLPGNALGSASTIITGKRLGTGQIGQAERQLRHVFWMSTIVLTAIAWGTAPFAGLFASFYTQEQDVKEVVKVLLWLNAAFMPIWAAAWVLPSGFKGARDVRFAMWVSMLGMWGCRVVAGYTLGIVLGMGVVGVWLGMFLDWAVRGALFYWRLISGRWLWRYLRVKRE

SEQ ID NO: 14843 - DNA, 1458 bp, Salmonella typhimurium LT2
  CDS (1)..(1458): transl_table=11
atgtggtttcaactctcttctttaaggtccattttgaacgtctccactgccttacgccaggctgtcgtccgtacgccctggtatgccaaacgcaagagctacaaagtgttgttctggcgtgaaatcaccccacttgctatccctatttttctggaaaatacctgtgttttgctaatgggcgtgctcagtacttttctcgtcagttggctgggcaaggaagcaatggcgggcgtggggcttgccgacagttttaatatggtaattatggctttttttgcggctatcgatcttggtactacggtggtggtcgcctttagcctcggcaagcgcgacaggcgacgcgcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtgctgagttatccggctgcggcaattgcgctaatcggtagcggcgcgctgcgtggggcagggaatacgaaaatcccgttgatgattaacggcgggatgaacattctcaatattattatcagcagcatcctgatttacggggctttctcctggcaagggctgggttttgccggcgcggggctgggattaaccatttcgcgctacatcggcgcggtagcgattatttgggtgctgatgattggttttaatccggcgctgcgcattccgctgaaaagctatctgaagccgctgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaacctgccgggtaacgcccttggttcggcgtcgactattatcaccggtaagcgtcttggtaccgggcaaattggtcaggcagagcgtcaactgcgccatgtattctggatgtcgactatcgtacttacggcaattgcctgggggacggcgccgtttgcgggtctgtttgcctcattttatacccaggagcaggacgtaaaagaggtagtgaaagttctgctctggcttaatgctgcctttatgccaatttgggcggccgcgtgggtgttgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaa

SEQ ID NO: 14844 - protein, 485 aa, Salmonella typhimurium LT2
MWFQLSSLRSILNVSTALRQAVVRTPWYAKRKSYKVLFWREITPLAIPIFLENTCVLLMGVLSTFLVSWLGKEAMAGVGLADSFNMVIMAFFAAIDLGTTVVVAFSLGKRDRRRARAAARQSLVIMTLFAVVLAVVIHYFGSEIINIVAGEATPEVKGLALTYLELTVLSYPAAAIALIGSGALRGAGNTKIPLMINGGMNILNIIISSILIYGAFSWQGLGFAGAGLGLTISRYIGAVAIIWVLMIGFNPALRIPLKSYLKPLNFGIIWEVMGIGIPASIESVLFNGGKLLTQMFVAGMGTNVIAGNFIAFSVAALINLPGNALGSASTIITGKRLGTGQIGQAERQLRHVFWMSTIVLTAIAWGTAPFAGLFASFYTQEQDVKEVVKVLLWLNAAFMPIWAAAWVLPSGFKGARDVRFAMWVSMLGMWGCRVVAGYTLGIVLGMGVVGVWLGMFLDWAVRGALFYWRLISGRWLWRYPRVKRE

SEQ ID NO: 14845 - DNA, 1431 bp, Yersinia pestis KIM
  CDS (1)..(1431): transl_table=11
atgcaaatgaacagggtttcagaggccgttaagttgaaaatcttccgcgaaagcgtgtggtataagaagcgaaaatcatctcgggtactcttttggcgtgagatcacaccgctggcctttccgttgtttattgaaggtttgtgcgtactgctgatgggggtatttagtactctgctggtgagttggttgggtaaagaagcgatggcagcggtggggctagccgacagtttcaatatgctgattgcggctttttttgcctccgtggcattagggacctcggtcgttgtggccttcagtctgggccaacgcaaacgccagcaggcgcaaactgccgcccgacaatccatgacattgctggtattaatctccctgttattagttgtcttggttcatttttcaggccagaccattattgatttaatggctaaccaggcagacccctcggttaaagcaatggccctgacctatctgcatttcactgtctggaattaccctgcgatggcgataaccttggtggggtgcggtgcgttacgtggtgcgggcaatacgcgtttgccgatgcttattaacattggcatgaacattcttaacattgtcattagcagtatattaatttatggcctctttaattggcagggactgggttttatcggtgccggtattggcatcacattggcccgctctgcaggcgcactggtggtggtcgtgctgctgatttacggcgcgaataatacgttgcggatccccttcaaagcctatttcatgccttttacctcggccattatgtttgaggtgctgagcattggtattccggcgagtgttgagtcagttatgttcaatattggcaagttaatcactcaacggtttgttgccggcatggggaccgacgtgatcgcgggtaactttattgccttttcaattgtggcgataatcaatctgcccggtaatgcgctggggtacacctcaaccattattattggtacccggctgggcaaggggcaaattttgcaacctattcggcagataaaacatatcttttggctatcgacgcttggggtctgctttattgcattgctgtccattcccagtgcgggttttctggcctcgctgtataccgatgatccggcagttatcacggtggtgaagcatttgatctggatgaatgcgttatttatgccgatttgggcggcgtcttgggtcttacctgccggcttgaaaggcgctaaggatgccagttacaccatgtgggttgccctggccgggatgtggggctgtcgcattattgctggctacattctgggggtaacgctagggtttggcgtgacgggggtatggatggggatgttcctggattggatggtccggggggtgttgttttatcgccgcatgtccacgggccgttggttatggcgctaccggcccagcgtctga

SEQ ID NO: 14846 - protein, 476 aa, Yersinia pestis KIM
MQMNRVSEAVKLKIFRESVWYKKRKSSRVLFWREITPLAFPLFIEGLCVLLMGVFSTLLVSWLGKEAMAAVGLADSFNMLIAAFFASVALGTSVVVAFSLGQRKRQQAQTAARQSMTLLVLISLLLVVLVHFSGQTIIDLMANQADPSVKAMALTYLHFTVWNYPAMAITLVGCGALRGAGNTRLPMLINIGMNILNIVISSILIYGLFNWQGLGFIGAGIGITLARSAGALVVVVLLIYGANNTLRIPFKAYFMPFTSAIMFEVLSIGIPASVESVMFNIGKLITQRFVAGMGTDVIAGNFIAFSIVAIINLPGNALGYTSTIIIGTRLGKGQILQPIRQIKHIFWLSTLGVCFIALLSIPSAGFLASLYTDDPAVITVVKHLIWMNALFMPIWAASWVLPAGLKGAKDASYTMWVALAGMWGCRIIAGYILGVTLGFGVTGVWMGMFLDWMVRGVLFYRRMSTGRWLWRYRPSV

SEQ ID NO: 14847 - DNA, 1641 bp, Escherichia coli CFT073
  CDS (1)..(1641): transl_table=11
ttgaggcacatcttaacggcgaaaaatattttgtcaaacccgatttttaaatttcccaactgtttgccgtttctatcaacagtttgttgcatttgcagacaatttgttggcgaaaatctttgcagctttgctgattctccctcatcatttgaaatgtggtttcactttctgcaattaaggtcggctttgaatatctcctctgctttacgccaggttgttcacggcactcgctggcactctaaacgcaagagctacaaagtgttgttctggcgcgagataaccccgcttgctgttcctatcttcatggagaacgcctgtgtcctgttgatgggggtcctgagcacttttctggtcagctggctgggaaaagatgcgatggccggcgtggggttggcggacagcttcaatatggtcattatggctttttttgcagctatcgatcttggtactactgtcgttgtagcatttagtctcggtaagcgagatcgacgacgagcgagggtggcgacgcggcagtcattggtgatcatgacgttgtttgccgtactgttggcaacgctaattcatcattttggcgaacaaattattgatttcgtcgcgggtgatgccacgacagacgttaaagcactggcgttgacttatctggagctgaccgtactcagttatccagcagctgccatcactcttattggtagcggggcacttcgtggtgcagggaatacgaaaataccgctactgattgacggtagcctgaatattcttaatattattattagcggcatattgatttacggccttttctcctggccgggactgggatttgtcggggctgggttgggtttaaccatttctcgttatattggcgcagttgcaattttgtgggtgctggcgattggttttaatcctgcgctaaggatttcgttaaagagctattttaaaccgctgaattttagcattatctgggaagtcatggggattggtattccagcgagtgtcgaatcagtgttatttaccagtggtcggttattaacccaaatgttcgttgccgggatggggaccagcgttattgccggaaattttatcgcgttctcaattgcggctcttatcaacttacccggaagtgcgctcggttctgcttctacgatcattacaggccgaaggttgggggtagggcagatagcgcaagcagagattcagttgcggcatgtgttctggctgtccactcttggattaacggccatcgcctggctaacggctccctttgccggggttatggcatcgttttacacccaggatccacaggttaaacacgtcgttgtgattctgatttggctaaatgctttatttatgcctatttggtccgcctcatgggtgctacccgctggatttaaaggtgctcgtgatgcccgttacgccatgtgggtttcgatgttgagcatgtggggttgtcgggttgtagtcggttatgtgctgggaatcatgcttggctggggtgtggttggcgtctggatgggaatgtttgccgactgggctgtgcgggccgtgctgttttactggcgaatggttactggacgttggctatggaaataccctcgatccgagccgcaaaagtgtgaaaaaaagccagttgtatcggaataa

SEQ ID NO: 14848 - protein, 546 aa, Escherichia coli CFT073
MRHILTAKNILSNPIFKFPNCLPFLSTVCCICRQFVGENLCSFADSPSSFEMWFHFLQLRSALNISSALRQVVHGTRWHSKRKSYKVLFWREITPLAVPIFMENACVLLMGVLSTFLVSWLGKDAMAGVGLADSFNMVIMAFFAAIDLGTTVVVAFSLGKRDRRRARVATRQSLVIMTLFAVLLATLIHHFGEQIIDFVAGDATTDVKALALTYLELTVLSYPAAAITLIGSGALRGAGNTKIPLLIDGSLNILNIIISGILIYGLFSWPGLGFVGAGLGLTISRYIGAVAILWVLAIGFNPALRISLKSYFKPLNFSIIWEVMGIGIPASVESVLFTSGRLLTQMFVAGMGTSVIAGNFIAFSIAALINLPGSALGSASTIITGRRLGVGQIAQAEIQLRHVFWLSTLGLTAIAWLTAPFAGVMASFYTQDPQVKHVVVILIWLNALFMPIWSASWVLPAGFKGARDARYAMWVSMLSMWGCRVVVGYVLGIMLGWGVVGVWMGMFADWAVRAVLFYWRMVTGRWLWKYPRSEPQKCEKKPVVSE

SEQ ID NO: 14849 - DNA, 1458 bp, Salmonella enterica subsp. enterica serovar Typhi Ty2
  CDS (1)..(1458): transl_table=11
atgtggtttcaactctcttctttaaggtccattttgaacgtctccactgccttacgccaggttgtcgtccgtacgccctggtatgccaaacgcaagagctacaaagtgttgttctggcgtgaaatcaccccacttgctatccccatttttctggaaaatacctgtgttttgctaatgggcgtgctcagtacttttctcgtcagttggttgggcaaggaagcaatggcgggcgtggggcttgccgacagttttaatatggtaattatggctttttttgcggctatcgatcttggtactacggtggtggtcgcctttagcctcggcaagcgcgataggcgacgggcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtactgagttatccggctgcggcaattgcgctaatcggtagcggcgcgctgcgtggggcagggaatacgaaaatcccgttgatgattaacggcgggatgaacattctcaatattgtcatcagcagcatcctgatttacggggctttctcctggcaagggctgggttttgccggtgcggggctgggattaaccatttcgcgctacatcggcgcggtagcgattatttgggtgctgatgattggttttaatccggcgctgcgcattccgctgaaaagctatctgaagccgttgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaatctgccgggtaacgcccttggttcggcgtcgactattatcaccggtaagcgtcttggtaccgggcaaattggtcaggcagagcgtcaattgcgccatgtattctggatgtcgactatcgtacttacggcaatcgcctggggaacagcgccgttcgcgggtctgtttgcctcattttatacccaggagcaggacgtaaaagaggtagtgaaagttctgctctggcttaatgctgcctttatgccaatttgggctgccgcgtgggtgctgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaa

SEQ ID NO: 14850 - protein, 485 aa, Salmonella enterica subsp. enterica serovar Typhi Ty2
MWFQLSSLRSILNVSTALRQVVVRTPWYAKRKSYKVLFWREITPLAIPIFLENTCVLLMGVLSTFLVSWLGKEAMAGVGLADSFNMVIMAFFAAIDLGTTVVVAFSLGKRDRRRARAAARQSLVIMTLFAVVLAVVIHYFGSEIINIVAGEATPEVKGLALTYLELTVLSYPAAAIALIGSGALRGAGNTKIPLMINGGMNILNIVISSILIYGAFSWQGLGFAGAGLGLTISRYIGAVAIIWVLMIGFNPALRIPLKSYLKPLNFGIIWEVMGIGIPASIESVLFNGGKLLTQMFVAGMGTNVIAGNFIAFSVAALINLPGNALGSASTIITGKRLGTGQIGQAERQLRHVFWMSTIVLTAIAWGTAPFAGLFASFYTQEQDVKEVVKVLLWLNAAFMPIWAAAWVLPSGFKGARDVRFAMWVSMLGMWGCRVVAGYTLGIVLGMGVVGVWLGMFLDWAVRGALFYWRLISGRWLWRYPRVKRE

SEQ ID NO: 14851 - DNA, 1437 bp, Klebsiella pneumoniae subsp. pneumoniae MGH 78578
  CDS (1)..(1437): transl_table=11
ttgaacgtcacctccgccgtacgccaggccgtcgaacggacatcctggtttaaaaaacgtcagcgttatcgtgtgctgtactggcgcgaaatcagccctctcgctgtgcccattctgctggaaaatgcctgtgtgctgctgatgggggtgttgagcaccttccttgtcagctggctgggaaaagaggccatggccggggtggggctggccgatagctttaacatggtcatcatgtccttctttgccgccatcgatctgggcaccacggtggtggtggcctttagcctcggcaagcgcgatcggcggcgggcgagggcggccgcgcgccagtcgctggccattatgaccctgttttccattttgctggcgggggtgatccatgcctttggccaggagattattgattttgtcgccggcgatgccaccgcccaggtcaaggacctggcgctgacctatctggaactgacggcgctgagctacccggcggcggcgattgcgctgatcggcagcggggcgctgcgcggcgccggcaccaccaaaatcccgctgctgatcaacggcgggatgaacatcctcaatatcttaatcagcagcgtgctcatctacggcatcttctcctggccggggctagggtttgtcggcgccgggcttgggctgaccattgcccgctatattggcgcgttagccacgatctgggtgctgatggtgggcctcaatccggcgctgcggctgtcgctgaagggctacttcaaaccctttaacttcgccattatctgggaggtgatggggatcggcatcccggccagtatcgaatctgtcctgttcaatggcggcaagctgctgacccagatgtttgtcgccgggatgggcaccaacgttatcgccggcaactttatcgccttttcggtggcctcgctaattaacctgccgggcaacgccctcggctctgcctcgacgatcattaccggcaagcggctgggaaaagggcagattggtcaggctgaattccaggcctggcacgtattttggctgtcgacgatcattctgacgctgatcgcctggggcagcgcccccttcgccggctttatcgcctcgttctacacccatgaagaagatgtaaaagaagtggttaaacagctgctgtggctcaacgccctgtttatgccgatctggtcgctgtcgtggactttaccctgcgcttttaaaggcgcccgtgacgtacgctacaccatgtgggtgtcgatgctcggcatgtggggctgccgggtggtggcgggctataccctgggcatcgtgctggggatgggggtgattggcgtctggttagggatggtgctcgactgggcggtgcgcggcgtgctgttttatttccgcatggtgagcggccgctggctgtggaaatatccgcgcgtaaaggcttcatcggaggaaagctga

SEQ ID NO: 14852 - protein, 478 aa, Klebsiella pneumoniae subsp. pneumoniae MGH 78578
MNVTSAVRQAVERTSWFKKRQRYRVLYWREISPLAVPILLENACVLLMGVLSTFLVSWLGKEAMAGVGLADSFNMVIMSFFAAIDLGTTVVVAFSLGKRDRRRARAAARQSLAIMTLFSILLAGVIHAFGQEIIDFVAGDATAQVKDLALTYLELTALSYPAAAIALIGSGALRGAGTTKIPLLINGGMNILNILISSVLIYGIFSWPGLGFVGAGLGLTIARYIGALATIWVLMVGLNPALRLSLKGYFKPFNFAIIWEVMGIGIPASIESVLFNGGKLLTQMFVAGMGTNVIAGNFIAFSVASLINLPGNALGSASTIITGKRLGKGQIGQAEFQAWHVFWLSTIILTLIAWGSAPFAGFIASFYTHEEDVKEVVKQLLWLNALFMPIWSLSWTLPCAFKGARDVRYTMWVSMLGMWGCRVVAGYTLGIVLGMGVIGVWLGMVLDWAVRGVLFYFRMVSGRWLWKYPRVKASSEES

SEQ ID NO: 14853 - DNA, 1431 bp, Salmonella enterica subsp. arizonae serovar 62:z4,z23:--
  CDS (1)..(1431): transl_table=11
ttgaacgtctccactaccttacgcaaggttgtcgtccgtacgccctggtatgccaaacgcaagagctacaaagtgttgttctggcgcgaaatcaccccacttgctatccccatttttctggaaaatacctgtgttctgctgatgggcgtgctcagcacttttcttgtcagttggctgggcaaggaagcaatggctggggtggggcttgccgacagttttaatatggtgattatggctttttttgccgcgatcgatctggggacgacggttgttgtcgcctttagtctgggtaagcgcgaccgtcgacgagccagggcggccgccaggcagtcgctggtgatcatgacgctgtttgccgtattgctggcggccgtcatacactattttggcaagcagattattgatgtcgttgccggagaggctactgcagatgtaaaagatctggcgctaatctatctggaattaacggttctcagttatccggcggccgctattgctctgattggcagcggtgctttgcgtggtgccggaaatacgaaaatacccctgctgattaatggcagcatgaatatgctgaacattatcatcagcagcattcttatctacggttttttttcctggcaaggactcgggttcattggcgctgggctggggttgactatctctcgctacattggcgctatcgcaattatctgggttttaatgattgggtttaaccccgcgctacgtattccccttaaaagttattttaaacccttaaactttgccattatttgggaagtgatgggtatcggggttccagccagcgttgagtcggttttgtttaatagcgggaaattacttacacagatatttgttgctggtatgggcaccagcgtcatcgccggtaattttattgcattttccattgcggcgttaattaaccttccgggaaatgctttaggttcagcatccactatcattacagggcgtcggctaggaaatggacagataacccaggcagaaatccaacttcgccacgtgttctggctttctactataggcctgacggccatcgcgtggattagcgctccctttgccggtattatggcgtcattttatacccacgacccggacgtcaaagatgtcgtggtgatccttatctggctgaatgcggcatttatgcctatttgggccgcctcatgggtactgcctgccggttttaaaggcgcacgcgacgcgcgtttcgccatgtgggtctcaatgcttggaatgtggggctgccgcgttgttgcaggctacgtgctgggaatagtacttggctggggcgtggtcggtatctggctgggtatgtttttcgactgggccgtacgtgccgctctcttttactggagaatggttagcggaagatggctatggaaatatccgcgccctgaacgaaaaacaagatga

SEQ ID NO: 14854 - protein, 476 aa, Salmonella enterica subsp. arizonae serovar 62:z4,z23:--
MNVSTTLRKVVVRTPWYAKRKSYKVLFWREITPLAIPIFLENTCVLLMGVLSTFLVSWLGKEAMAGVGLADSFNMVIMAFFAAIDLGTTVVVAFSLGKRDRRRARAAARQSLVIMTLFAVLLAAVIHYFGKQIIDVVAGEATADVKDLALIYLELTVLSYPAAAIALIGSGALRGAGNTKIPLLINGSMNMLNIIISSILIYGFFSWQGLGFIGAGLGLTISRYIGAIAIIWVLMIGFNPALRIPLKSYFKPLNFAIIWEVMGIGVPASVESVLFNSGKLLTQIFVAGMGTSVIAGNFIAFSIAALINLPGNALGSASTIITGRRLGNGQITQAEIQLRHVFWLSTIGLTAIAWISAPFAGIMASFYTHDPDVKDVVVILIWLNAAFMPIWAASWVLPAGFKGARDARFAMWVSMLGMWGCRVVAGYVLGIVLGWGVVGIWLGMFFDWAVRAALFYWRMVSGRWLWKYPRPERKTR

SEQ ID NO: 14855 - DNA, 1425 bp, Salmonella enterica subsp. enterica serovar Paratyphi B str. SPB7
  CDS (1)..(1425): transl_table=11
ttgaacgtctccactgccttacgccaggctgtcgtccgtacgccctggtatgccaaacgcaagagctacaaagtgttgttctggcgtgaaatcaccccacttgctatccctatttttctggaaaatacctgtgttttgctaatgggcgtgctcagtacttttctcgtcagttggctgggcaaggaagcaatggcgggcgtggggcttgccgacagttttaatatggtaattatggctttttttgcggctatcgatcttggtactacggtggtggtcgcctttagcctcggcaagcgcgacaggcgacgcgcaagggcggcggcgcgccagtcgctggtgattatgacgctatttgccgttgtgctggcagtggtcattcattatttcggcagtgaaattattaatattgtcgcaggcgaggcgacgccagaagtaaaggggctggcgttaacgtaccttgaactgacggtgctgagttatccggctgcggcaattgcgctaatcggtagcggcgcgctgcgtggggcagggaatacgaaaatcccgttgatgattaacggcgggatgaacattctcaatattattatcagcagcatcctgatttacggggctttctcctggcaagggctgggttttgccggcgcggggctgggattaaccatttcgcgctacatcggcgcggtagcgattatttgggtgctgatgattggttttaatccggcgctgcgcattccgctgaaaagctatctgaagccgctgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaacctgccgggtaacgcccttggttcggcgtcgactattatcaccggtaagcgtcttggtaccgggcaaattggtcaggcagagcgtcaactgcgccatgtattctggatgtcgactatcgtacttacggcaattgcctgggggacggcgccgtttgcgggtctgtttgcctcattttatacccaggagcaggacgtaaaagaggtagtgaaagttctgctctggcttaatgctgcctttatgccaatttgggcggccgcgtgggtgttgccgtcgggttttaaaggcgcgcgcgatgtgcgatttgcgatgtgggtatcgatgctggggatgtggggctgtcgcgttgtggcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaa

SEQ ID NO: 14856 - protein, 474 aa, Salmonella enterica subsp. enterica serovar Paratyphi B str. SPB7
MNVSTALRQAVVRTPWYAKRKSYKVLFWREITPLAIPIFLENTCVLLMGVLSTFLVSWLGKEAMAGVGLADSFNMVIMAFFAAIDLGTTVVVAFSLGKRDRRRARAAARQSLVIMTLFAVVLAVVIHYFGSEIINIVAGEATPEVKGLALTYLELTVLSYPAAAIALIGSGALRGAGNTKIPLMINGGMNILNIIISSILIYGAFSWQGLGFAGAGLGLTISRYIGAVAIIWVLMIGFNPALRIPLKSYLKPLNFGIIWEVMGIGIPASIESVLFNGGKLLTQMFVAGMGTNVIAGNFIAFSVAALINLPGNALGSASTIITGKRLGTGQIGQAERQLRHVFWMSTIVLTAIAWGTAPFAGLFASFYTQEQDVKEVVKVLLWLNAAFMPIWAAAWVLPSGFKGARDVRFAMWVSMLGMWGCRVVAGYTLGIVLGMGVVGVWLGMFLDWAVRGALFYWRLISGRWLWRYPRVKRE

SEQ ID NO: 14857 - DNA, 1428 bp, Erwinia carotovora subsp. atroseptica SCRI1043
  CDS (1)..(1428): transl_table=11
ttgagatctatccaagaccgtttcatgaaaaaattaaaagatacagactggtataaaaagcgttactccaaccgcgttctcttctggagagaaatctcgccgctagccttccccatctttattgaaggtctatgcgtcgtgctcatgggggttttcagcactttcctggtcagttggttggggaaagaggccatggcagccgtcggcctggctgacagcttcaatatggttattatcgccttctttaccgctgtcgccttggggaccgccgttgttgtcgctttcagtctgggccagcgcaatagaaagcaggcacgttctgccgctcgccaatcaatgtcattactcgtcctgtcatcatttctgttagttgctctggttgaattcgccggttctgcaatcatcgatctgatcgcaggacaggccgatgaacaggtgaaggtgcttgctctcacgtttcttcgctggacggtatggggatatcccgctgtcgccgttgcgctagtcggctgcggcgcactgcggggcgcgggtaacactaaattgcctatggtcatcaacattgggatgaatatcctcaatattgccatcagcagcctgctaatctacggcgcattttcctgggatggtatcggctttattggcgcgggcattggtattaccatttcacgttacattggggcggtacttgttattctgacgctgatgcacggttttaacggtgcgttgcgcattcccttcaagtcttactttgcaccttttaccctatcgatcctctatgaagtgctcagcatcggcattcccgccagcattgaatccgtgatgtttaatatcggcaagctcatcacccagcgttttgtggcaggtatggggaccgaagtcattgccggaaactttattgccttctccatctcaacgctgatcaatcttcctggcaattcgctcggtgcagccgccactatcatcgttggcacacgattagggaaaggccagattatgcagtctactcgacagctgaagcacatcttctggctgtccaatattgggttatgtactcttgccatactgtcggtgcccagcgccagctttttggcgtcgttttacaccaatgagccagaagtgatcgaggtggcaaaacaccttctgtggctcaacgcactatttatgccaatctgggctgcatcctgggtgctacccgccgggttaaaaggcgcgaaagatgccagttacaccatgtgggtggcgatggcaggaatgtggggatgccgtgttatcgcgggatacatcctcggcgtgatgctcggccttggcgtgatcggcgtgtggatggggatgttctttgactggattgtacgcgggttcttctattaccgccgtctgatgagcgggcgctggctatggcgctatcgccctccgactgattcatga

SEQ ID NO: 14858 - protein, 475 aa, Erwinia carotovora subsp. atroseptica SCRI1043
MRSIQDRFMKKLKDTDWYKKRYSNRVLFWREISPLAFPIFIEGLCVVLMGVFSTFLVSWLGKEAMAAVGLADSFNMVIIAFFTAVALGTAVVVAFSLGQRNRKQARSAARQSMSLLVLSSFLLVALVEFAGSAIIDLIAGQADEQVKVLALTFLRWTVWGYPAVAVALVGCGALRGAGNTKLPMVINIGMNILNIAISSLLIYGAFSWDGIGFIGAGIGITISRYIGAVLVILTLMHGFNGALRIPFKSYFAPFTLSILYEVLSIGIPASIESVMFNIGKLITQRFVAGMGTEVIAGNFIAFSISTLINLPGNSLGAAATIIVGTRLGKGQIMQSTRQLKHIFWLSNIGLCTLAILSVPSASFLASFYTNEPEVIEVAKHLLWLNALFMPIWAASWVLPAGLKGAKDASYTMWVAMAGMWGCRVIAGYILGVMLGLGVIGVWMGMFFDWIVRGFFYYRRLMSGRWLWRYRPPTDS

SEQ ID NO: 14859 - DNA, 1470 bp, Klebsiella pneumoniae
  CDS (1)..(1470): transl_table=11
atgttgtttcaacatttctcactaaggtctctcttgaacgtcacctccgccgtacgccaggccgtcgaacggacatcctggtttaaaaaacgtcagcgttatcgtgtgctgtactggcgcgaaatcagccctctcgctgtgcccattctgctggaaaatgcctgtgtgctgctgatgggggtgttgagcaccttccttgtcagctggctgggaaaagaggccatggccggagtggggctggccgatagctttaacatggtcatcatgtccttctttgccgccatcgatttgggcaccacggtggtggtggcctttagcctcggcaagcgcgatcggcggcgagcgagagcggccgcgcgccagtcgctggccattatgaccctgttttccattttgctggcgggggtgatccatgcctttggccaggagattattgattttgtcgccggcgatgccaccgcccaggtcaaggacctggcgctgacctatctggaactgacggcgctgagctacccggcggcggcgattgcgttgatcggcagcggggcgctgcgcggcgccggcaccaccaaaatcccgctgctgatcaacggcgggatgaacattctcaatatcttaatcagcagcgtgctcatctacggcatcttctcctggccggggctggggtttgtcggcgccgggcttgggctgaccattgcccgctatattggcgcgatagccacgatctgggtgctgatggtgggcctcaatccggcgctgcggctgtcgctgaagggctacttcaaaccctttaacttcgccattatctgggaggtgatggggatcggcatcccggccagtatcgaatcggtcctgttcaatggcggcaagctgctgacccagatgtttgtcgccgggatgggcaccaacgttatcgccggcaactttatcgccttttcggtggcctcgctaattaacctgccgggcaacgccctcggctctgcctcgacgatcattaccggcaagcggctgggaaaagggcagattggtcaggctgaattccaggcctggcacgtattttggctgtcgacgatcattctgacgctgatcgcctggggcagcgcccccttcgccggctttatcgcctcgttctacacccatgaagaagatgtaaaagaagtggttaaacagctgctgtggctcaacgccctgtttatgccgatctggtcgctgtcgtggactttaccctgcgcttttaaaggcgcccgtgacgtacgctacaccatgtgggtgtcgatgctcggcatgtggggctgccgggtggtggcgggctataccctgggcatcgtgctggggatgggggtgattggcgtctggttagggatggtgctcgactgggcggtgcgcggcgtgctgttttatttccgcatggtgagcgggcgctggctgtggaaatacccgcgcgtgaaggcttcgtcggaggaaagctga

SEQ ID NO: 14860 - protein, 489 aa, Klebsiella pneumoniae
MLFQHFSLRSLLNVTSAVRQAVERTSWFKKRQRYRVLYWREISPLAVPILLENACVLLMGVLSTFLVSWLGKEAMAGVGLADSFNMVIMSFFAAIDLGTTVVVAFSLGKRDRRRARAAARQSLAIMTLFSILLAGVIHAFGQEIIDFVAGDATAQVKDLALTYLELTALSYPAAAIALIGSGALRGAGTTKIPLLINGGMNILNILISSVLIYGIFSWPGLGFVGAGLGLTIARYIGAIATIWVLMVGLNPALRLSLKGYFKPFNFAIIWEVMGIGIPASIESVLFNGGKLLTQMFVAGMGTNVIAGNFIAFSVASLINLPGNALGSASTIITGKRLGKGQIGQAEFQAWHVFWLSTIILTLIAWGSAPFAGFIASFYTHEEDVKEVVKQLLWLNALFMPIWSLSWTLPCAFKGARDVRYTMWVSMLGMWGCRVVAGYTLGIVLGMGVIGVWLGMVLDWAVRGVLFYFRMVSGRWLWKYPRVKASSEES

SEQ ID NO: 14861 - DNA, 1644 bp, Escherichia coli
  CDS (1)..(1644): transl_table=11
ctgttgaggcacatcttaacggcgaaaaatattttgtcaaacccgatttttaaatttcccaactgtttgccgtttctatcaacagtttgttgcatttgcagacaatttgttggcgaaaatctttgcagctttgctgattctccctcatcatttgaaatgtggtttcactttctgcaattaaggtcggctttgaatatctcctctgctttacgccaggttgttcacggcactcgctggcactctaaacgcaagagctacaaagtgttgttctggcgcgagataaccccgcttgctgttcctatcttcatggagaacgcctgtgtcctgttgatgggggtcctgagcacttttctggtcagctggctgggaaaagatgcgatggccggcgtggggttggcggacagcttcaatatggtcattatggctttttttgcagctatcgatcttggtactactgtcgttgtagcatttagtctcggtaagcgagatcgacgacgagcgagggtggcgacgcggcagtcattggtgatcatgacgttgtttgccgtactgttggcaacgctaattcatcattttggcgaacaaattattgatttcgtcgcgggtgatgccacgacagacgttaaagcactggcgttgacttatctggagctgaccgtactcagttatccagcagctgccatcactcttattggtagcggggcacttcgtggtgcagggaatacgaaaataccgctactgattaacggtagcctgaatattcttaatattattattagcggcatattgatttacggccttttctcctggccgggactgggatttgtcggggctgggttgggtttaaccatttctcgttatattggcgcagttgcaattttgtgggtgctggcgattggttttaatcctgcgctaaggatttcgttaaagagctattttaaaccgctgaattttagcattatctgggaagtcatggggattggtattccagcgagtgtcgaatcagtgttatttaccagtggtcggttattaacccaaatgttcgttgccgggatggggaccagcgttattgccggaaattttatcgcgttctcaattgcggctcttatcaacttacccggaagtgcgctcggttctgcttctacgatcattacaggccgaaggttgggggtagggcagatagcgcaagcagagattcagttgcggcatgtgttctggctgtccactcttggattaacggccatcgcctggctaacggctccctttgccggggttatggcatcgttttacacccaggatccacaggttaaacacgtcgttgtgattctgatttggctaaatgctttatttatgcctatttggtccgcctcatgggtgctacccgctggatttaagggtgctcgtgatgcccgttacgccatgtgggtttctatgttgagcatgtggggttgccgggttgtagtcggttatgtgctgggaatcatgcttggctggggtgtggttggtgtctggatgggaatgtttgccgactgggctgtgcgggccgtgctgttttactggcgaatggttactggacgttggctgtggaaataccctcgatccgagccgcaaaagtgtgaaaaaaagccagttgtgtcggaataa

SEQ ID NO: 14862 - protein, 547 aa, Escherichia coli
MLRHILTAKNILSNPIFKFPNCLPFLSTVCCICRQFVGENLCSFADSPSSFEMWFHFLQLRSALNISSALRQVVHGTRWHSKRKSYKVLFWREITPLAVPIFMENACVLLMGVLSTFLVSWLGKDAMAGVGLADSFNMVIMAFFAAIDLGTTVVVAFSLGKRDRRRARVATRQSLVIMTLFAVLLATLIHHFGEQIIDFVAGDATTDVKALALTYLELTVLSYPAAAITLIGSGALRGAGNTKIPLLINGSLNILNIIISGILIYGLFSWPGLGFVGAGLGLTISRYIGAVAILWVLAIGFNPALRISLKSYFKPLNFSIIWEVMGIGIPASVESVLFTSGRLLTQMFVAGMGTSVIAGNFIAFSIAALINLPGSALGSASTIITGRRLGVGQIAQAEIQLRHVFWLSTLGLTAIAWLTAPFAGVMASFYTQDPQVKHVVVILIWLNALFMPIWSASWVLPAGFKGARDARYAMWVSMLSMWGCRVVVGYVLGIMLGWGVVGVWMGMFADWAVRAVLFYWRMVTGRWLWKYPRSEPQKCEKKPVVSE

SEQ ID NO: 14863 - DNA, 1527 bp, Salmonella choleraesuis
  CDS (1)..(1527): transl_table=11
ttgttgcatttgcagacattttttctgcaaaaagctttgcagccttacgatttctcgctcattattgaaatgtggtttcaactctcttctttaaggtccattttgaacgtctccactgccttacgccaggctgtcgtccgtacgccctggtatgccaaacgcaagagctacaaagtgttgttctggcgtgaaatcaccccacttgctatccctatttttctggaaaatacctgtgttttgctaatgggcgtgctcagtacttttctcgtcagttggctgggcaaggaagcaatggcgggcgtggggcttgccgacagttttaatatggtaattatggctttttttgcggctatcgatcttggtactacggtggtggtcgcctttagcctcggcaagcgcgacaggcgacgcgcaagggcggcggcgcgccagtcgctggtgattatgacgctatttgccgttgtgctggcagtggtcattcattatttcggcagtgaaattattaatattgtcgcaggcgaggcgacgtcagaagtaaaggggctggcgttaacgtaccttgaactgacggtgctgagttatccggctgcggcaattgcgctaatcggtagcggcgcgctgcgtggggcagggaatacgaaaatcccgttgatgattaacggcgggatgaacattctcaatattatcatcagcagcatcctgatttacggggctttctcctggcaagggctgggttttgccggcgcggggctgggattaaccatttcgcgctacatcggcgcggtagcgattatttgggtgctgatgattggttttaatccggcgctgcgcattccgctgaaaagctatctgaagccgctgaatttcggcattatctgggaagtgatgggtatcggtattccggcgagcattgaatcagtgctgttcaacggtggcaagctactgacgcaaatgtttgtcgccggaatgggcactaacgttattgcgggtaactttattgccttttccgtggcggcgcttatcaacctgccgggtaacgctcttggttcggcgtcgactattatcaccggtaagcgtcttggtaccgggcaaattggtcaggcagagcgtcaactgcgccatgtattctggatgtcgactatcgtacttacggcaattgcctgggggacggcgccgtttgcgggtccgtttgcctcattttatacccaggagcaggacgtaaaagaggtagtgaaagttctgctctggcttaatgctgcctttatgccaatttgggcggccgcgtgggtgttgccgtcgggttttaaaggcgcgcgcgatgtgcgatttgcgatgtgggtatcgatgctggggatgtggggctgtcgcgttgtagcagggtatacgcttggtattgtgctgggtatgggggttgtaggggtttggctggggatgtttcttgactgggccgtgcgtggcgcactgttttactggcgtctgataagcgggcgctggctgtggagatacccgcgcgtaaagagggagtaa

SEQ ID NO: 14864 - protein, 508 aa, Salmonella choleraesuis
MLHLQTFFLQKALQPYDFSLIIEMWFQLSSLRSILNVSTALRQAVVRTPWYAKRKSYKVLFWREITPLAIPIFLENTCVLLMGVLSTFLVSWLGKEAMAGVGLADSFNMVIMAFFAAIDLGTTVVVAFSLGKRDRRRARAAARQSLVIMTLFAVVLAVVIHYFGSEIINIVAGEATSEVKGLALTYLELTVLSYPAAAIALIGSGALRGAGNTKIPLMINGGMNILNIIISSILIYGAFSWQGLGFAGAGLGLTISRYIGAVAIIWVLMIGFNPALRIPLKSYLKPLNFGIIWEVMGIGIPASIESVLFNGGKLLTQMFVAGMGTNVIAGNFIAFSVAALINLPGNALGSASTIITGKRLGTGQIGQAERQLRHVFWMSTIVLTAIAWGTAPFAGPFASFYTQEQDVKEVVKVLLWLNAAFMPIWAAAWVLPSGFKGARDVRFAMWVSMLGMWGCRVVAGYTLGIVLGMGVVGVWLGMFLDWAVRGALFYWRLISGRWLWRYPRVKRE

SEQ ID NO: 14865 - DNA, 1443 bp, Escherichia fergusonii
  CDS (1)..(1443): transl_table=11
atgcgcacgccatggtatgcaaagcgtaaaagctatcgtgttctgttctggcgtgaaatcaccccccttgccgtgcctattttcctggaaaacacctgcgttctgttgatgggggtgctgagtaccttcctggtcagctggctgggtaaagaggcgatggccggtgtcgggctggcggacagctttaacatggtggttatttctttttttgccgccattgacctcgggacgacagttgtcgtcgcctttagcctcggcaagctcgatcctaaacgtgcgcgcgaggctgcccgacagtcgctgatgatcatgaccattttctcgatcgtgctggcggcggtgatccactatttcggcagggaaattatcgattttgtcgccggtgaggccacaaatgaagttaaagacctggcgctgacctacctggaaatgacggtcctgagttatccggctgcagccatcgcgctgattggcagcggcgcgctgcgcggggcgggcaacaccaaaattccgttgctgataaacggcgggatgaacatcctgaatattattatcagcagcgtgctgatctacggcgtcttctcctgggacgggctcgggttcgtgggtgccgggctggggttaacgatttcacgttatatcggtgcggccgccattctcggggtgctgatggcggggatcacgccgtcactgcgccttacgctgaagagctatttccgcccctttaacttcgccattatctgggaagtgatgggaattggtattcccgccagtattgaatccgtgttgtttaacgggggcaagctgttgacgcaaatgtttgtcgccgggatggggactgatgttatcgccggtaactttattgccttctccatcgcctccctgataaacctgccgggcaacgccctcggttcggcgtcgaccatcatcactggtaaacggctgggaaaagggcagatagggcaggcggaacggcagttgcggcacgtcttctggctgtcaaccattggcctgacgttgatcgcctggggaagcgccccctttgccgggcttatggcctctttttatacccacgaagatgatgtcaaagaggtcgttaagatcctgatctggctgaacgcggcctttatgcccatctgggcggcttcatgggttctgcctgccgggctgaaaggggcacgcgatgcacgcttcgcgatgtgggtatcaatgctcggcatgtggggttgccgcgtggtggtgggttacacgctcggggtcatgcttggcatgggggttgtcggcgtctggctggggatgttccttgactgggcggtgcgtggggcgttgttctactggcgtatggtcagtgggcgctggctctggaaatacccgcgaataaaacaggaaccgacgaccacagaatcaacaaaatgcctgacaaatgcgcgaagtggagaataa

SEQ ID NO: 14866 - protein, 480 aa, Escherichia fergusonii
MRTPWYAKRKSYRVLFWREITPLAVPIFLENTCVLLMGVLSTFLVSWLGKEAMAGVGLADSFNMVVISFFAAIDLGTTVVVAFSLGKLDPKRAREAARQSLMIMTIFSIVLAAVIHYFGREIIDFVAGEATNEVKDLALTYLEMTVLSYPAAAIALIGSGALRGAGNTKIPLLINGGMNILNIIISSVLIYGVFSWDGLGFVGAGLGLTISRYIGAAAILGVLMAGITPSLRLTLKSYFRPFNFAIIWEVMGIGIPASIESVLFNGGKLLTQMFVAGMGTDVIAGNFIAFSIASLINLPGNALGSASTIITGKRLGKGQIGQAERQLRHVFWLSTIGLTLIAWGSAPFAGLMASFYTHEDDVKEVVKILIWLNAAFMPIWAASWVLPAGLKGARDARFAMWVSMLGMWGCRVVVGYTLGVMLGMGVVGVWLGMFLDWAVRGALFYWRMVSGRWLWKYPRIKQEPTTTESTKCLTNARSGE

SEQ ID NO: 14867 - DNA, 24 bp, Artificial sequence
  primer
atgttgaggcacatcttaacggcg

SEQ ID NO: 14868 - DNA, 25 bp, Artificial sequence
  primer
ttattccgacacaactggctttttt

SEQ ID NO: 14869 - protein, 457 aa, Artificial sequence
  consensus sequence
  Variant (2)..(2): Xaa in position 2 is any amino acid
  Variant (4)..(5): Xaa in position 4 to 5 is any amino acid
  Variant (8)..(8): Xaa in position 8 is any amino acid
  Variant (11)..(11): Xaa in position 11 is any amino acid
  Variant (19)..(19): Xaa in position 19 is any amino acid
  Variant (23)..(23): Xaa in position 23 is any amino acid
  Variant (27)..(27): Xaa in position 27 is any amino acid
  Variant (30)..(30): Xaa in position 30 is any amino acid
  Variant (49)..(49): Xaa in position 49 is any amino acid
  Variant (65)..(66): Xaa in position 65 to 66 is any amino acid
  Variant (89)..(89): Xaa in position 89 is any amino acid
  Variant (93)..(93): Xaa in position 93 is any amino acid
  Variant (95)..(95): Xaa in position 95 is any amino acid
  Variant (100)..(100): Xaa in position 100 is any amino acid
  Variant (106)..(108): Xaa in position 106 to 108 is any amino acid
  Variant (111)..(112): Xaa in position 111 to 112 is any amino acid
  Variant (115)..(115): Xaa in position 115 is any amino acid
  Variant (118)..(119): Xaa in position 118 to 119 is any amino acid
  Variant (122)..(123): Xaa in position 122 to 123 is any amino acid
  Variant (127)..(127): Xaa in position 127 is any amino acid
  Variant (130)..(131): Xaa in position 130 to 131 is any amino acid
  Variant (134)..(134): Xaa in position 134 is any amino acid
  Variant (142)..(142): Xaa in position 142 is any amino acid
  Variant (153)..(153): Xaa in position 153 is any amino acid
  Variant (171)..(171): Xaa in position 171 is any amino acid
  Variant (175)..(176): Xaa in position 175 to 176 is any amino acid
  Variant (182)..(182): Xaa in position 182 is any amino acid
  Variant (185)..(186): Xaa in position 185 to 186 is any amino acid
  Variant (191)..(191): Xaa in position 191 is any amino acid
  Variant (195)..(195): Xaa in position 195 is any amino acid
  Variant (200)..(200): Xaa in position 200 is any amino acid
  Variant (209)..(209): Xaa in position 209 is any amino acid
  Variant (215)..(215): Xaa in position 215 is any amino acid
  Variant (217)..(219): Xaa in position 217 to 219 is any amino acid
  Variant (222)..(223): Xaa in position 222 to 223 is any amino acid
  Variant (225)..(225): Xaa in position 225 is any amino acid
  Variant (231)..(232): Xaa in position 231 to 232 is any amino acid
  Variant (235)..(235): Xaa in position 235 is any amino acid
  Variant (237)..(238): Xaa in position 237 to 238 is any amino acid
  Variant (240)..(240): Xaa in position 240 is any amino acid
  Variant (243)..(243): Xaa in position 243 is any amino acid
  Variant (257)..(257): Xaa in position 257 is any amino acid
  Variant (263)..(264): Xaa in position 263 to 264 is any amino acid
  Variant (266)..(266): Xaa in position 266 is any amino acid
  Variant (271)..(271): Xaa in position 271 is any amino acid
  Variant (279)..(279): Xaa in position 279 is any amino acid
  Variant (290)..(290): Xaa in position 290 is any amino acid
  Variant (292)..(292): Xaa in position 292 is any amino acid
  Variant (299)..(299): Xaa in position 299 is any amino acid
  Variant (311)..(311): Xaa in position 311 is any amino acid
  Variant (315)..(315): Xaa in position 315 is any amino acid
  Variant (319)..(319): Xaa in position 319 is any amino acid
  Variant (323)..(323): Xaa in position 323 is any amino acid
  Variant (325)..(326): Xaa in position 325 to 326 is any amino acid
  Variant (331)..(331): Xaa in position 331 is any amino acid
  Variant (334)..(335): Xaa in position 334 to 335 is any amino acid
  Variant (338)..(338): Xaa in position 338 is any amino acid
  Variant (342)..(343): Xaa in position 342 to 343 is any amino acid
  Variant (349)..(350): Xaa in position 349 to 350 is any amino acid
  Variant (356)..(359): Xaa in position 356 to 359 is any amino acid
  Variant (362)..(362): Xaa in position 362 is any amino acid
  Variant (365)..(366): Xaa in position 365 to 366 is any amino acid
  Variant (368)..(368): Xaa in position 368 is any amino acid
  Variant (373)..(373): Xaa in position 373 is any amino acid
  Variant (379)..(379): Xaa in position 379 is any amino acid
  Variant (381)..(381): Xaa in position 381 is any amino acid
  Variant (386)..(386): Xaa in position 386 is any amino acid
  Variant (388)..(388): Xaa in position 388 is any amino acid
  Variant (394)..(394): Xaa in position 394 is any amino acid
  Variant (396)..(397): Xaa in position 396 to 397 is any amino acid
  Variant (404)..(404): Xaa in position 404 is any amino acid
  Variant (412)..(412): Xaa in position 412 is any amino acid
  Variant (415)..(415): Xaa in position 415 is any amino acid
  Variant (418)..(419): Xaa in position 418 to 419 is any amino acid
  Variant (422)..(422): Xaa in position 422 is any amino acid
  Variant (425)..(425): Xaa in position 425 is any amino acid
  Variant (429)..(429): Xaa in position 429 is any amino acid
  Variant (433)..(433): Xaa in position 433 is any amino acid
  Variant (439)..(440): Xaa in position 439 to 440 is any amino acid
  Variant (444)..(444): Xaa in position 444 is any amino acid
  Variant (446)..(448): Xaa in position 446 to 448 is any amino acid
  Variant (454)..(454): Xaa in position 454 is any amino acid
  Variant (456)..(456): Xaa in position 456 is any amino acid
TXWXXKRXSYXVLFWREIXPLAXPIFXENXCVLLMGVLSTFLVSWLGKXAMAGVGLADSFNMVIXXFFAAIDLGTTVVVAFSLGKRDRXRARXAXRQSLXIMTLFXXXLAXXIHXFGXXIIXXVAGXATXXVKXLALTYLEXTVLSYPAAAIXLIGSGALRGAGNTKIPLXINGXXNILNIXISXXLIYGXFSWXGLGFXGAGLGLTIXRYIGAXAXXXVLXXGXNPALRXXLKXYXXPXNFXIIWEVMGIGIPASXESVLFXXGXLLTQXFVAGMGTXVIAGNFIAFSXAXLINLPGXALGSASTIITGXRLGXGQIXQAEXQXXHVFWXSTXXLTXIAWXXAPFAGXXASFYTXXXXVKXVVXXLXWLNAXFMPIWXAXWVLPXGXKGARDXRXXMWVSMLXMWGCRVVXGYXLGXXLGXGVXGVWXGMFXDWAVRXXLFYXRXXXGRWLWXYXR

SEQ ID NO: 14870 - protein, 60 aa, Artificial sequence
  protein pattern
  Variant (2)..(7): Xaa in position 2 to 7 is any amino acid
  Variant (9)..(9): Xaa in position 9 is Lys or Arg
  Variant (12)..(12): Xaa in position 12 is Phe or Tyr
  Variant (17)..(17): Xaa in position 17 is Ser or Thr
  Variant (21)..(21): Xaa in position 21 is Ile or Val
  Variant (24)..(24): Xaa in position 24 is Phe or Leu
  Variant (25)..(25): Xaa in position 25 is Leu or Met
  Variant (28)..(28): Xaa in position 28 is Ala or Thr
  Variant (47)..(47): Xaa in position 47 is Asp or Glu
WXXXXXXYXVLXWREIXPLAXPIXXENXCVLLMGVLSTFLVSWLGKXAMAGVGLADSFNM

SEQ ID NO: 14871 - protein, 62 aa, Artificial sequence
  protein pattern
  Variant (6)..(6): Xaa in position 6 is any amino acid
  Variant (7)..(8): Xaa in position 7 to 8 is any or no amino acid
  Variant (10)..(11): Xaa in position 10 to 11 is any or no amino acid
  Variant (14)..(14): Xaa in position 14 is Asp, Glu or His
  Variant (17)..(18): Xaa in position 17 to 18 is any amino acid
  Variant (20)..(20): Xaa in position 20 is Ile or Leu
  Variant (25)..(25): Xaa in position 25 is Ala or Leu
  Variant (31)..(31): Xaa in position 31 is Ala or Ser
  Variant (32)..(32): Xaa in position 32 is Ala or Leu
  Variant (33)..(33): Xaa in position 33 is Ala or Ser
  Variant (35)..(35): Xaa in position 35 is Thr or Val
  Variant (38)..(38): Xaa in position 38 is Ala, Cys or Ser
  Variant (39)..(39): Xaa in position 39 is Ala or Gly
  Variant (40)..(40): Xaa in position 40 is Phe or Leu
  Variant (46)..(46): Xaa in position 46 is Ala or Val
  Variant (48)..(48): Xaa in position 48 is Phe or Tyr
  Variant (49)..(49): Xaa in position 49 is Ala or Thr
  Variant (56)..(56): Xaa in position 56 is Gly or Ser
ASFYTXXXDXXVKXVVXXLXWLNAXFMPIWXXXWXLPXXXKGARDXRXXMWVSMLXMWGCRV

SEQ ID NO: 14872 - protein, 60 aa, Artificial sequence
  protein pattern
  Variant (2)..(2): Xaa in position 2 is Ile or Leu
  Variant (3)..(3): Xaa in position 3 is Pro, Ser or Thr
  Variant (6)..(6): Xaa in position 6 is Gly or Ser
  Variant (8)..(8): Xaa in position 8 is Phe or Leu
  Variant (9)..(9): Xaa in position 9 is Lys or Arg
  Variant (11)..(11): Xaa in position 11 is Phe or Leu
  Variant (14)..(14): Xaa in position 14 is Ala, Gly or Ser
  Variant (24)..(24): Xaa in position 24 is Ile or Val
  Variant (28)..(28): Xaa in position 28 is Ile or Val
  Variant (34)..(34): Xaa in position 34 is any amino acid
  Variant (35)..(35): Xaa in position 35 is any or no amino acid
  Variant (37)..(37): Xaa in position 37 is Lys or Arg
  Variant (42)..(42): Xaa in position 42 is Ile or Met
  Variant (50)..(50): Xaa in position 50 is Asp, Asn or Ser
RXXLKXYXXPXNFXIIWEVMGIGXPASXESVLFXXGXLLTQXFVAGMGTXVIAGNFIAFS

SEQ ID NO: 14873 - protein, 60 aa, Artificial sequence
  protein pattern
  Variant (2)..(2): Xaa in position 2 is any amino acid
  Variant (6)..(6): Xaa in position 6 is Leu or Met
  Variant (8)..(8): Xaa in position 8 is Ala or Val
  Variant (17)..(17): Xaa in position 17 is Ala or Thr
  Variant (29)..(29): Xaa in position 29 is Asn or Thr
  Variant (35)..(35): Xaa in position 35 is Leu or Met
  Variant (37)..(37): Xaa in position 37 is Asp or Asn
  Variant (39)..(39): Xaa in position 39 is Gly or Ser
  Variant (40)..(40): Xaa in position 40 is Leu or Met
  Variant (42)..(42): Xaa in position 42 is Ile or Met
  Variant (46)..(46): Xaa in position 46 is Ile, Leu or Val
  Variant (49)..(49): Xaa in position 49 is Gly or Ser
  Variant (50)..(50): Xaa in position 50 is Ile or Val
  Variant (55)..(55): Xaa in position 55 is any amino acid
  Variant (59)..(59): Xaa in position 59 is Asp, Pro or Gln
LXYLEXTXLSYPAAAIXLIGSGALRGAGXTKIPLXIXGXXNXLNIXISXXLIYGXFSWXG

SEQ ID NO: 14874 - protein, 55 aa, Artificial sequence
  protein pattern
  Variant (6)..(6): Xaa in position 6 is Asn or Ser
  Variant (18)..(18): Xaa in position 18 is Lys or Arg
  Variant (22)..(22): Xaa in position 22 is any amino acid
  Variant (26)..(26): Xaa in position 26 is Ala, Gly or Thr
  Variant (30)..(30): Xaa in position 30 is any amino acid
  Variant (32)..(32): Xaa in position 32 is Ala or Leu
  Variant (33)..(33): Xaa in position 33 is any amino acid
  Variant (38)..(38): Xaa in position 38 is Leu or Met
  Variant (41)..(41): Xaa in position 41 is Ile or Leu
  Variant (42)..(42): Xaa in position 42 is Gly, Ile or Val
  Variant (45)..(45): Xaa in position 45 is Ala or Leu
  Variant (49)..(49): Xaa in position 49 is Gly, Ile or Leu
  Variant (50)..(50): Xaa in position 50 is Ser or Thr
INLPGXALGSASTIITGXRLGXGQIXQAEXQXXHVFWXSTXXLTXIAWXXAPFAG

SEQ ID NO: 14875 - protein, 56 aa, Artificial sequence
  protein pattern
  Variant (20)..(20): Xaa in position 20 is any amino acid
  Variant (22)..(22): Xaa in position 22 is any amino acid
  Variant (23)..(23): Xaa in position 23 is Lys or Arg
  Variant (27)..(27): Xaa in position 27 is any amino acid
  Variant (29)..(29): Xaa in position 29 is Ala or Thr
  Variant (34)..(34): Xaa in position 34 is any amino acid
  Variant (38)..(38): Xaa in position 38 is Ile or Leu
  Variant (40)..(40): Xaa in position 40 is Ala or Ser
  Variant (41)..(41): Xaa in position 41 is Ile or Val
  Variant (42)..(42): Xaa in position 42 is Leu or Val
  Variant (45)..(45): Xaa in position 45 is Ala, Gly, Thr or Val
  Variant (46)..(46): Xaa in position 46 is Leu or Val
  Variant (49)..(49): Xaa in position 49 is any amino acid
  Variant (52)..(52): Xaa in position 52 is any amino acid
  Variant (53)..(53): Xaa in position 53 is Glu or Gln
  Variant (56)..(56): Xaa in position 56 is Asp or Asn
FFAAIDLGTTVVVAFSLGKXDXXRARXAXRQSLXIMTXFXXXLAXXIHXFGXXIIX

SEQ ID NO: 14876 - protein, 37 aa, Artificial sequence
  protein pattern
  Variant (2)..(2): Xaa in position 2 is any or no amino acid
  Variant (4)..(5): Xaa in position 4 to 5 is any or no amino acid
  Variant (7)..(7): Xaa in position 7 is Ile or Val
  Variant (11)..(11): Xaa in position 11 is Leu or Met
  Variant (14)..(14): Xaa in position 14 is Phe or Val
  Variant (15)..(15): Xaa in position 15 is any amino acid
  Variant (18)..(18): Xaa in position 18 is Ala or Ile
  Variant (21)..(21): Xaa in position 21 is Ala or Gly
  Variant (22)..(22): Xaa in position 22 is any amino acid
  Variant (23)..(23): Xaa in position 23 is Phe or Leu
  Variant (24)..(24): Xaa in position 24 is Phe or Tyr
  Variant (26)..(26): Xaa in position 26 is any amino acid
  Variant (28)..(28): Xaa in position 28 is Leu or Met
  Variant (29)..(29): Xaa in position 29 is Ile, Met or Val
  Variant (30)..(30): Xaa in position 30 is Ser or Thr
  Variant (36)..(36): Xaa in position 36 is Lys or Arg
MXGXXVXGVWXGMXXDWXVRXXXXYXRXXXGRWLWXY

SEQ ID NO: 14877 - protein, 29 aa, Artificial sequence
  protein pattern
  Variant (2)..(3): Xaa in position 2 to 3 is any or no amino acid
  Variant (11)..(11): Xaa in position 11 is Ala or Ser
  Variant (17)..(17): Xaa in position 17 is Ala, Ile, Leu or Val
  Variant (19)..(19): Xaa in position 19 is any amino acid
  Variant (20)..(20): Xaa in position 20 is Ile or Leu
  Variant (21)..(21): Xaa in position 21 is any amino acid
  Variant (24)..(24): Xaa in position 24 is any amino acid
  Variant (25)..(25): Xaa in position 25 is Ala, Ile or Val
  Variant (27)..(27): Xaa in position 27 is Phe, Ile or Leu
  Variant (28)..(28): Xaa in position 28 is Asn or Thr
FXXAGLGLTIXRYIGAXAXXXVLXXGXXP

SEQ ID NO: 14878 - protein, 11 aa, Artificial sequence
  protein pattern
  Variant (4)..(4): Xaa in position 4 is Asp or Glu
  Variant (7)..(7): Xaa in position 7 is Ala, Asn, Pro, Ser or Thr
  Variant (8)..(8): Xaa in position 8 is Asp, Glu or Gln
  Variant (11)..(11): Xaa in position 11 is Ala, Asp or Gly
VAGXATXXVKX

SEQ ID NO: 14879 - DNA, 330 bp, Escherichia coli
  CDS (1)..(330): transl_table=11
atgaacactctacctgctacaatttcgcaggcggcgaagccctgcctgtcgccagtggctgtctggcaaatgctactgacacgcctgctggaacaacactatggcctgacactgaacgacacgccgttcagtgatgaaactgttattaaggaacatatcgatgctggtatcactctggccgatgcagtcaattttctggtggaaaagtacgaactggtacgtatcgatcacagaggattttcgtggcaacaacagtctccatatatttccgtagtagatattctgcgagcaaggcgctctaccggcttgctaaaaactaatgtgaaataa

SEQ ID NO: 14880 - protein, 109 aa, Escherichia coli
MNTLPATISQAAKPCLSPVAVWQMLLTRLLEQHYGLTLNDTPFSDETVIKEHIDAGITLADAVNFLVEKYELVRIDHRGFSWQQQSPYISVVDILRARRSTGLLKTNVK

SEQ ID NO: 14881 - DNA, 378 bp, Shigella flexneri 2a str. 301
  CDS (1)..(378): transl_table=11
atgaatacattacccgacactcacgtacgggaggcatcgggctgcccgtctcccatcaccatctggcagacactgctcacccgactgctggaccagcactatggcctcacgctgaatgacacaccgttcgctgatgaacgtgtgattgagcagcatattgaggcaggaatttcactgtgtgacgcggtgaactttctcgttgaaaaatacgcgctggtacgtaccgaccagccgggattcagcgcaggagccccgtcgcagttaatcaacagcattgatattctccgggcacgccgggcaaccggcctgatgacccgcgataactacagaacggtaaataacattacccgggggaagcatccggaagcgaaacaatga

SEQ ID NO: 14882 - protein, 125 aa, Shigella flexneri 2a str. 301
MNTLPDTHVREASGCPSPITIWQTLLTRLLDQHYGLTLNDTPFADERVIEQHIEAGISLCDAVNFLVEKYALVRTDQPGFSAGAPSQLINSIDILRARRATGLMTRDNYRTVNNITRGKHPEAKQ

SEQ ID NO: 14883 - DNA, 378 bp, Escherichia coli CFT073
  CDS (1)..(378): transl_table=11
atgaaaacattacctgacacacacgtacgggaggcatcgcgctgcccgtctcccgtcaccatctggcagacactgctcacccaactgttggaccagcattacggcctcacactgaatgacacaccgttcgctgatgaacgtgtgattgagcagcatattgaggcaggcatttcactgtgcgatgcggtgaactttctcgttgaaaaatacgcactggtacgtaccgaccagccaggattcagcgcttgtacccgttctcagttaataaacagtattgatatcctccgggcccgccgggcaaccggcctgatgacccgcagcaactacagaatggtgaacgacatcatccggggtgaacattcggaggcgaaacgatga

SEQ ID NO: 14884 - protein, 125 aa, Escherichia coli CFT073
MKTLPDTHVREASRCPSPVTIWQTLLTQLLDQHYGLTLNDTPFADERVIEQHIEAGISLCDAVNFLVEKYALVRTDQPGFSACTRSQLINSIDILRARRATGLMTRSNYRMVNDIIRGEHSEAKR

SEQ ID NO: 14885 - DNA, 381 bp, Escherichia coli CFT073
  CDS (1)..(381): transl_table=11
atgaaaacattacctgacacacacgtacgggaggcatcgcgctgcccgtctcccgtcaccatctggcagacactgctcacccgactgttggaccagcattacggcctcacactgaatgacacaccgttcgctgatgaacgtgtgattgagcagcatattgaggcagggatttcactgtgtgacgcggtgaactttctcgttgaaaaatacgcgctggtacgaactgaccagccgggattcagcgcaggagtcccgtcgcagttaatcaacagcatcgatattctccgggcccgccgggcaaccggcctgatgacccgcgacaattacagaacggtaaatgacattaccctgggcaggcatccggaggaggcgaaacaatga

SEQ ID NO: 14886 - protein, 126 aa, Escherichia coli CFT073
MKTLPDTHVREASRCPSPVTIWQTLLTRLLDQHYGLTLNDTPFADERVIEQHIEAGISLCDAVNFLVEKYALVRTDQPGFSAGVPSQLINSIDILRARRATGLMTRDNYRTVNDITLGRHPEEAKQ

SEQ ID NO: 14887 - DNA, 378 bp, Escherichia coli CFT073
  CDS (1)..(378): transl_table=11
atgaaaacattacccgacacacacatacgggaggcatcgcactgcccgtctcccgtcaccatctggcagacactgctcacccgactgctggaccagcactacggcctcgcgctgaatgacacaccgttcgctgatgaacgtgtgattgagcagcatattgaagcgggcatttcactgtgtgatgcggtgaactttctcgttgagaaatacgcgctggtacgtaccgaccagccgggattcagcgcaggagcctcgtcgcagttaatcaacagcattgatattctccgggctcgccgggcaacaggcctgatgaccagccacaactacagaacggtgaacaatatcaccctgggtaagcatccggaggcgaaacgatga

SEQ ID NO: 14888 - protein, 125 aa, Escherichia coli CFT073
MKTLPDTHIREASHCPSPVTIWQTLLTRLLDQHYGLALNDTPFADERVIEQHIEAGISLCDAVNFLVEKYALVRTDQPGFSAGASSQLINSIDILRARRATGLMTSHNYRTVNNITLGKHPEAKR

SEQ ID NO: 14889 - DNA, 378 bp, Escherichia coli CFT073
  CDS (1)..(378): transl_table=11
atgaaaacattacccgatacacacgtacgggaggcatcgagctgcccgtctcccgtcaccatctggcagactctgctctcccgactactgggccagcattacggccttaccctgaatgacacaccgttcgccgatgaacgtgtgattgagcagcatattgaggcaggcatttcactgtgtgacgcggtgaactttctcgttgaaaaatacgcactggtgcgtaccgaccagccggaattcagtgcctgtacccgttctcagttaataaacagtattgatatcctccgggcacgccgggcaaccggcctgatgacccgcgacaactacagaacggtaaatgacattaccctgggtaagcatccggaggcgaaacaatga

SEQ ID NO: 14890 - protein, 125 aa, Escherichia coli CFT073
MKTLPDTHVREASSCPSPVTIWQTLLSRLLGQHYGLTLNDTPFADERVIEQHIEAGISLCDAVNFLVEKYALVRTDQPEFSACTRSQLINSIDILRARRATGLMTRDNYRTVNDITLGKHPEAKQ

SEQ ID NO: 14891 - DNA, 288 bp, Photorhabdus luminescens subsp. laumondii TTO1
  CDS (1)..(288): transl_table=11
gtgcttgtctggcaaactctacttacacgtctgctggagcaacattatggcctcaccctgaatgacacgccgttcagcgatgaaactgttattcaggaacatatcaacgctggtattacattggctgatgccgttaactttttggtagaaaagtacgaactggttcgtatcgacctcaggaggtttaactgtcaggagcaatcaccttatcttcgggctgtagatattttacgggcaaggcaagcaaccggccttttgcggcaaagccatcatccttcaactcgctga

SEQ ID NO: 14892 - protein, 95 aa, Photorhabdus luminescens subsp. laumondii TTO1
MLVWQTLLTRLLEQHYGLTLNDTPFSDETVIQEHINAGITLADAVNFLVEKYELVRIDLRRFNCQEQSPYLRAVDILRARQATGLLRQSHHPSTR

SEQ ID NO: 14893 - DNA, 378 bp, Salmonella enterica subsp. enterica serovar Paratyphi B str. SPB7
  CDS (1)..(378): transl_table=11
atgcagattttaccctcactcccgcccggggcgacttcgtcacaccccacgcctgtcggcatctggcagaccctgctgtcgcatctgctgcaacaacactacggtctgatgctgaacgacaccccgtttgctaacgacggcgtcattgagcagcatatcaacgccggcatctccctgtgcgatgcgctgaacggtattgttgaaaaatatgacctggtccggaccgaccgcccgggattcagtattgcagtgcagtctccgttcattacccgtatcgatattctccgcgccagaaaagcctgtggcctgatgaaacgtcgtggctaccgggccgttaccgacatcaccaccggcagatacagcggggtggcacgatga

SEQ ID NO: 14894 - protein, 125 aa, Salmonella enterica subsp. enterica serovar Paratyphi B str. SPB7
MQILPSLPPGATSSHPTPVGIWQTLLSHLLQQHYGLMLNDTPFANDGVIEQHINAGISLCDALNGIVEKYDLVRTDRPGFSIAVQSPFITRIDILRARKACGLMKRRGYRAVTDITTGRYSGVAR

SEQ ID NO: 14895 - DNA, 321 bp, Pectobacterium atrosepticum SCRI1043
  CDS (1)..(321): transl_table=11
atgcaaacatcaccagcaatccctcgacgggaggataacccctgtccgtcacccatagccgcttggcagcaacttatgacctacctgctggaaaagcactacggcctgatgctgaatgacacaccgttctgcgaggaaaacgtgattcaggaacatatcgatgctggcatcacgttggtcaatgccgtgaattttctggtggaaaaatacgaactggtgcgtatcgaccgcgacggttttaactggcaggagcaatcaccgtttctcactgccgttgatgttctccgtgctagacgcgcaacaggtttacttaaggcataa

SEQ ID NO: 14896 - protein, 106 aa, Pectobacterium atrosepticum SCRI1043
MQTSPAIPRREDNPCPSPIAAWQQLMTYLLEKHYGLMLNDTPFCEENVIQEHIDAGITLVNAVNFLVEKYELVRIDRDGFNWQEQSPFLTAVDVLRARRATGLLKA

SEQ ID NO: 14897 - DNA, 465 bp, Yersinia pseudotuberculosis IP 32953
  CDS (1)..(465): transl_table=11
atgtgtatctcgctatttatcctactccccaatcaactgcataaatcttcgccttttatttctatcgatcatctagctaactacgagataacccatatgcagatcttacctgttactccgaaacgggcggcttatgcttgcccatcacccgttgttgtctggcaatccatgctcacgtatctgctggaacagcattacggattggctcttaacgataccgagttcagtgatgacgccgtgatccacgaatatattgatgctggtatctctctgtccgatgcgttgaatttcacggtggaaaagtttggcctggttcgtatcgatcgccgggggttctcctgccaggaacaatctcccttcatcacggctatcgatattctccgtgcccgtcgagccaccggcctgatgacccgtctgggttaccagaccatcatctcagttatccggggcgaaaagcagacatga

SEQ ID NO: 14898 - protein, 154 aa, Yersinia pseudotuberculosis IP 32953
MCISLFILLPNQLHKSSPFISIDHLANYEITHMQILPVTPKRAAYACPSPVVVWQSMLTYLLEQHYGLALNDTEFSDDAVIHEYIDAGISLSDALNFTVEKFGLVRIDRRGFSCQEQSPFITAIDILRARRATGLMTRLGYQTIISVIRGEKQT

SEQ ID NO: 14899 - DNA, 483 bp, Escherichia coli
  CDS (1)..(483): transl_table=11
gtggttacgtttatctggctgtttatccgacaccggcagcgcccgcaatcaccgtataaccccggatatctcccctttatcaccacctgttacagagaacttaagatgaatacattacccgacactcacgtacgggaggcatcgggctgcccgtctcccgtcaccatctggcagacactgctcacccgactgctggaccagcactatggcctcacgctgaatgacacaccgttcgctgatgaacgtgtgattgagcagcatattgaggcagggatttcactgtgtgacgcggtgaactttctcgttgaaaaatacgcgctggtacgtaccgaccagccgggattcagcgcaggagccccgtcgcagttaatcaacagcattgatattctccgggctcgcagggcaaccggcctgatgacccggaacaattacagaatggtaaataacattacccagggcaagcatccggaggcaaaacaatga

SEQ ID NO: 14900 - protein, 160 aa, Escherichia coli
MVTFIWLFIRHRQRPQSPYNPGYLPFITTCYRELKMNTLPDTHVREASGCPSPVTIWQTLLTRLLDQHYGLTLNDTPFADERVIEQHIEAGISLCDAVNFLVEKYALVRTDQPGFSAGAPSQLINSIDILRARRATGLMTRNNYRMVNNITQGKHPEAKQ

SEQ ID NO: 14901 - DNA, 483 bp, Escherichia coli
  CDS (1)..(483): transl_table=11
gtggttacgtttatatggctgtttatccgacactggcacccgcaaccacctcataaccccgaatatctcacctttagcactaccagttacagagaacttaagatgaaaacattacctgacacacacgtacgggaggcatcgcgctgcccgtctcccgtcaccatctggcagacactgctcacccgactgttggaccagcattacggcctcacactgaatgacacaccgttcgctgatgaacgtgtgattgagcagcatattgaggcagggatttcactgtgtgacgcggtgaactttctcgttgaaaaatacgcgctggtacgaactgaccagccgggattcagcgcaggagtcccgtcgcagttaatcaacagcatcgatattctccgggcccgccgggcaaccggcctgatgacccgcgacaattacagaacggtaaatgacattaccctgggcaggcatccggaggaggcgaaacaatga

SEQ ID NO: 14902 - protein, 160 aa, Escherichia coli
MVTFIWLFIRHWHPQPPHNPEYLTFSTTSYRELKMKTLPDTHVREASRCPSPVTIWQTLLTRLLDQHYGLTLNDTPFADERVIEQHIEAGISLCDAVNFLVEKYALVRTDQPGFSAGVPSQLINSIDILRARRATGLMTRDNYRTVNDITLGRHPEEAKQ

SEQ ID NO: 14903 - DNA, 378 bp, Escherichia coli
  CDS (1)..(378): transl_table=11
atgaaaacattacccgatacacacgtacgggaggcatcgcgctgcccgtctcccgtcatcatctggcagacactgctcacccgactgctggaccagcactacggcctcacgctgaatgacacaccgttcgctgatgaacgtgtgattgagcagcatattgaggcaggcatttcactgtgtgacgcggtgaactttctcgttgaaaaatacgcgctggtacgtaccgaccagtcgggattcagcgcctgtacccactctcagttaataaacagcatcgatatcctccgggctcgccgggcaacaggcctgatgactcgcgacaatttaagaacggtaaataacattaccctgggtaaacatccagaggcgaaacaatga

SEQ ID NO: 14904 - protein, 125 aa, Escherichia coli
MKTLPDTHVREASRCPSPVIIWQTLLTRLLDQHYGLTLNDTPFADERVIEQHIEAGISLCDAVNFLVEKYALVRTDQSGFSACTHSQLINSIDILRARRATGLMTRDNLRTVNNITLGKHPEAKQ

SEQ ID NO: 14905 - DNA, 375 bp, Escherichia coli O6
  CDS (1)..(375): transl_table=11
atgaaaacattacctgtattacccgggcaggcggccagttctcgcccgtctcctgttgaaatctggcagatactgctgtcccgactgctggaccagcactacggcctcacactgaatgacacaccgtttgccgatgaacgtgtgattgagcagcatattgaggcaggcatttcactgtgtgatgcggtgaactttctcgtggaaaaatacgcgctggtgcgtaccgaccagccgggattcagcgcctgtacccgctctcagttaataaacagcatcgatatcctccgggctcgcagggcgaccggcctgatgacccgcgacaattacagaacggtaaataacattaccctgggtaagtatccggaggcgaaatga

SEQ ID NO: 14906 - protein, 124 aa, Escherichia coli O6
MKTLPVLPGQAASSRPSPVEIWQILLSRLLDQHYGLTLNDTPFADERVIEQHIEAGISLCDAVNFLVEKYALVRTDQPGFSACTRSQLINSIDILRARRATGLMTRDNYRTVNNITLGKYPEAK

SEQ ID NO: 14907 - DNA, 342 bp, Escherichia coli
  CDS (1)..(342): transl_table=11
atgaaaactttacctgcaataactcagcgggcggtgaagccctgcctgtcacccgtggctgtctggcaaatgttactgacacgtctgctggaacagcactatggtctgacaataaacgacacgccattctgcaatgaggctgtgattaaggaacacatcgatgccggtatcaccctagccgatgccgtgaattttctggtagaaaaatacgagctggttcgtatcgacaggaagggatttagctggcaggaacaatctccttatctccgggctgcagacattctgcgagcgcggcaggcaactggcttgttgcggcaaagccgtaacaacgtagtacgatga

SEQ ID NO: 14908 - protein, 113 aa, Escherichia coli
MKTLPAITQRAVKPCLSPVAVWQMLLTRLLEQHYGLTINDTPFCNEAVIKEHIDAGITLADAVNFLVEKYELVRIDRKGFSWQEQSPYLRAADILRARQATGLLRQSRNNVVR

SEQ ID NO: 14909 - DNA, 23 bp, Artificial sequence
  primer
atgaacactctacctgctacaat

SEQ ID NO: 14910 - DNA, 27 bp, Artificial sequence
  primer
ttatttcacattagtttttagcaagcc

SEQ ID NO: 14911 - protein, 112 aa, Artificial sequence
  consensus sequence
  Variant (2)..(2): Xaa in position 2 is any amino acid
  Variant (6)..(14): Xaa in position 6 to 14 is any amino acid
  Variant (20)..(21): Xaa in position 20 to 21 is any amino acid
  Variant (24)..(24): Xaa in position 24 is any amino acid
  Variant (28)..(28): Xaa in position 28 is any amino acid
  Variant (31)..(31): Xaa in position 31 is any amino acid
  Variant (37)..(37): Xaa in position 37 is any amino acid
  Variant (44)..(44): Xaa in position 44 is any amino acid
  Variant (47)..(47): Xaa in position 47 is any amino acid
  Variant (50)..(51): Xaa in position 50 to 51 is any amino acid
  Variant (54)..(54): Xaa in position 54 is any amino acid
  Variant (58)..(58): Xaa in position 58 is any amino acid
  Variant (60)..(60): Xaa in position 60 is any amino acid
  Variant (71)..(71): Xaa in position 71 is any amino acid
  Variant (75)..(75): Xaa in position 75 is any amino acid
  Variant (77)..(78): Xaa in position 77 to 78 is any amino acid
  Variant (82)..(85): Xaa in position 82 to 85 is any amino acid
  Variant (87)..(88): Xaa in position 87 to 88 is any amino acid
  Variant (90)..(92): Xaa in position 90 to 92 is any amino acid
  Variant (104)..(107): Xaa in position 104 to 107 is any amino acid
  Variant (108)..(111): Xaa in position 108 to 111 is any or no amino acid
MXTLPXXXXXXXXXCPSPVXXWQXLLTXLLXQHYGLXLNDTPFXDEXVIXXHIXAGIXLXDAVNFLVEKYXLVRXDXXGFSXXXXSXXIXXXDILRARRATGLXXXXXXXXV

SEQ ID NO: 14912 - protein, 61 aa, Artificial sequence
  protein pattern
  Variant (3)..(3): Xaa in position 3 is any amino acid
  Variant (6)..(6): Xaa in position 6 is Ser or Thr
  Variant (7)..(7): Xaa in position 7 is Gln or Arg
  Variant (10)..(10): Xaa in position 10 is Asp, Glu or Gly
  Variant (16)..(16): Xaa in position 16 is Ala or Thr
  Variant (17)..(17): Xaa in position 17 is Ile or Leu
  Variant (23)..(23): Xaa in position 23 is Ala, Cys or Ser
  Variant (24)..(24): Xaa in position 24 is Asp or Asn
  Variant (26)..(26): Xaa in position 26 is any amino acid
  Variant (29)..(29): Xaa in position 29 is any or no amino acid
  Variant (31)..(31): Xaa in position 31 is any or no amino acid
  Variant (34)..(34): Xaa in position 34 is Asp, Glu or Asn
  Variant (38)..(38): Xaa in position 38 is Ser or Thr
  Variant (40)..(40): Xaa in position 40 is Ala or Cys
  Variant (51)..(51): Xaa in position 51 is Ala or Glu
  Variant (55)..(55): Xaa in position 55 is any amino acid
  Variant (57)..(59): Xaa in position 57 to 59 is any amino acid
  Variant (61)..(61): Xaa in position 61 is Asn or Ser
WQXLLXXLLXQHYGLXXNDTPFXXEXVIXEXHIXAGIXLXDAVNFLVEKYXLVRXDXXXFX

SEQ ID NO: 14913 - protein, 18 aa, Artificial sequence
  protein pattern
  Variant (3)..(3): Xaa in position 3 is Ala, Asp or Val
  Variant (4)..(6): Xaa in position 4 to 6 is any amino acid
  Variant (7)..(7): Xaa in position 7 is Gln or Arg
  Variant (8)..(8): Xaa in position 8 is Ala or Glu
  Variant (9)..(9): Xaa in position 9 is Ala or Val
  Variant (10)..(12): Xaa in position 10 to 12 is any amino acid
  Variant (13)..(13): Xaa in position 13 is Leu or Pro
  Variant (16)..(16): Xaa in position 16 is Ile or Val
  Variant (17)..(17): Xaa in position 17 is any amino acid
  Variant (18)..(18): Xaa in position 18 is Ile or Val
LPXXXXXXXXXXXSPXXX

SEQ ID NO: 14914 - DNA, 1023 bp, Escherichia coli
  CDS (1)..(1023): transl_table=11
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaa

SEQ ID NO: 14915 - protein, 340 aa, Escherichia coli; identical to SEQ ID NO: 3861

SEQ ID NO: 14916 - DNA, 1023 bp, Escherichia coli; identical to SEQ ID NO: 3770
  CDS (1)..(1023): transl_table=11

SEQ ID NO: 14917 - protein, 340 aa, Escherichia coli; identical to SEQ ID NO: 3771

SEQ ID NO: 14918 - DNA, 948 bp, Bradyrhizobium sp. ORS278; identical to SEQ ID NO: 3772
  CDS (1)..(948): transl_table=11

SEQ ID NO: 14919 - protein, 315 aa, Bradyrhizobium sp. ORS278; identical to SEQ ID NO: 3773

SEQ ID NO: 14920 - DNA, 978 bp, Mesorhizobium loti MAFF303099; identical to SEQ ID NO: 3774
  CDS (1)..(978): transl_table=11

SEQ ID NO: 14921 - protein, 325 aa, Mesorhizobium loti MAFF303099; identical to SEQ ID NO: 3775

SEQ ID NO: 14922 - DNA, 954 bp, Pasteurella multocida subsp. multocida str. Pm70; identical to SEQ ID NO: 3776
  CDS (1)..(954): transl_table=11

SEQ ID NO: 14923 - protein, 317 aa, Pasteurella multocida subsp. multocida str. Pm70; identical to SEQ ID NO: 3777

SEQ ID NO: 14924 - DNA, 1023 bp, Escherichia coli O157:H7 EDL933; identical to SEQ ID NO: 3778
  CDS (1)..(1023): transl_table=11

SEQ ID NO: 14925 - protein, 340 aa, Escherichia coli O157:H7 EDL933; identical to SEQ ID NO: 3779

SEQ ID NO: 14926 - DNA, 1092 bp, Clostridium acetobutylicum ATCC 824; identical to SEQ ID NO: 3780
  CDS (1)..(1092): transl_table=11

SEQ ID NO: 14927 - protein, 363 aa, Clostridium acetobutylicum ATCC 824; identical to SEQ ID NO: 3781

SEQ ID NO: 14928 - DNA, 942 bp, Agrobacterium tumefaciens str. C58; identical to SEQ ID NO: 3782
  CDS (1)..(942): transl_table=11

SEQ ID NO: 14929 - protein, 313 aa, Agrobacterium tumefaciens str. C58; identical to SEQ ID NO: 3783

SEQ ID NO: 14930 - DNA, 984 bp, Sinorhizobium meliloti 1021; identical to SEQ ID NO: 3784
  CDS (1)..(984): transl_table=11

SEQ ID NO: 14931 - protein, 327 aa, Sinorhizobium meliloti 1021; identical to SEQ ID NO: 3785

SEQ ID NO: 14932 - DNA, 981 bp, Caulobacter crescentus CB15; identical to SEQ ID NO: 3786
  CDS (1)..(981): transl_table=11

SEQ ID NO: 14933 - protein, 326 aa, Caulobacter crescentus CB15; identical to SEQ ID NO: 3787

SEQ ID NO: 14934 - DNA, 996 bp, Brucella melitensis 16M; identical to SEQ ID NO: 3788
  CDS (1)..(996): transl_table=11

SEQ ID NO: 14935 - protein, 331 aa, Brucella melitensis 16M; identical to SEQ ID NO: 3789

SEQ ID NO: 14936 - DNA, 990 bp, Clostridium perfringens str. 13; identical to SEQ ID NO: 3790
  CDS (1)..(990): transl_table=11

SEQ ID NO: 14937 - protein, 329 aa, Clostridium perfringens str. 13; identical to SEQ ID NO: 3791

SEQ ID NO: 14938 - DNA, 1014 bp, Yersinia pestis KIM; identical to SEQ ID NO: 3792
  CDS (1)..(1014): transl_table=11

SEQ ID NO: 14939 - protein, 337 aa, Yersinia pestis KIM; identical to SEQ ID NO: 3793

SEQ ID NO: 14940 - DNA, 996 bp, Brucella suis 1330; identical to SEQ ID NO: 3794
  CDS (1)..(996): transl_table=11

SEQ ID NO: 14941 - protein, 331 aa, Brucella suis 1330; identical to SEQ ID NO: 3795

SEQ ID NO: 14942 - DNA, 1023 bp, Shigella flexneri 2a str. 301; identical to SEQ ID NO: 3796
  CDS (1)..(1023): transl_table=11

SEQ ID NO: 14943 - protein, 340 aa, Shigella flexneri 2a str. 301; identical to SEQ ID NO: 3797

SEQ ID NO: 14944 - DNA, 990 bp, Shewanella oneidensis MR-1; identical to SEQ ID NO: 3798
  CDS (1)..(990): transl_table=11

SEQ ID NO: 14945 - protein, 329 aa, Shewanella oneidensis MR-1; identical to SEQ ID NO: 3799

SEQ ID NO: 14946 - DNA, 948 bp, Bradyrhizobium japonicum USDA 110; identical to SEQ ID NO: 3800
  CDS (1)..(948): transl_table=11

SEQ ID NO: 14947 - protein, 315 aa, Bradyrhizobium japonicum USDA 110; identical to SEQ ID NO: 3801

SEQ ID NO: 14948 - DNA, 1011 bp, Vibrio parahaemolyticus RIMD 2210633; identical to SEQ ID NO: 3802
  CDS (1)..(1011): transl_table=11

SEQ ID NO: 14949 - protein, 336 aa, Vibrio parahaemolyticus RIMD 2210633; identical to SEQ ID NO: 3803

SEQ ID NO: 14950 - DNA, 1017 bp, Salmonella enterica subsp. enterica serovar Typhi Ty2; identical to SEQ ID NO: 3804
  CDS (1)..(1017): transl_table=11

SEQ ID NO: 14951 - protein, 338 aa, Salmonella enterica subsp. enterica serovar Typhi Ty2; identical to SEQ ID NO: 3805

SEQ ID NO: 14952 - DNA, 999 bp, Photorhabdus luminescens subsp. laumondii TTO1; identical to SEQ ID NO: 3806
  CDS (1)..(999): transl_table=11

SEQ ID NO: 14953 - protein, 332 aa, Photorhabdus luminescens subsp. laumondii TTO1; identical to SEQ ID NO: 3807

SEQ ID NO: 14954 - DNA, 999 bp, Vibrio vulnificus YJ016; identical to SEQ ID NO: 3808
  CDS (1)..(999): transl_table=11

SEQ ID NO: 14955 - protein, 332 aa, Vibrio vulnificus YJ016; identical to SEQ ID NO: 3809

SEQ ID NO: 14956 - DNA, 1047 bp, Rhodopseudomonas palustris CGA009; identical to SEQ ID NO: 3810
  CDS (1)..(1047): transl_table=11

SEQ ID NO: 14957 - protein, 348 aa, Rhodopseudomonas palustris CGA009; identical to SEQ ID NO: 3811

SEQ ID NO: 14958 - DNA, 1038 bp, Erwinia carotovora subsp. atroseptica SCRI1043; identical to SEQ ID NO: 3812
  CDS (1)..(1038): transl_table=11

SEQ ID NO: 14959 - protein, 345 aa, Erwinia carotovora subsp. atroseptica SCRI1043; identical to SEQ ID NO: 3813

SEQ ID NO: 14960 - DNA, 951 bp, Mannheimia succiniciproducens MBEL55E; identical to SEQ ID NO: 3814
  CDS (1)..(951): transl_table=11

SEQ ID NO: 14961 - protein, 316 aa, Mannheimia succiniciproducens MBEL55E; identical to SEQ ID NO: 3815

SEQ ID NO: 14962 - DNA, 963 bp, Silicibacter pomeroyi DSS-3; identical to SEQ ID NO: 3816
  CDS (1)..(963): transl_table=11

SEQ ID NO: 14963 - protein, 320 aa, Silicibacter pomeroyi DSS-3; identical to SEQ ID NO: 3817

SEQ ID NO: 14964 - DNA, 936 bp, Haemophilus influenzae 86-028NP; identical to SEQ ID NO: 3818
  CDS (1)..(936): transl_table=11

SEQ ID NO: 14965 - protein, 311 aa, Haemophilus influenzae 86-028NP; identical to SEQ ID NO: 3819

SEQ ID NO: 14966 - DNA, 1005 bp, Colwellia psychrerythraea 34H; identical to SEQ ID NO: 3820
  CDS (1)..(1005): transl_table=11

SEQ ID NO: 14967 - protein, 334 aa, Colwellia psychrerythraea 34H; identical to SEQ ID NO: 3821

SEQ ID NO: 14968 - DNA, 993 bp, Novosphingobium aromaticivorans DSM 12444; identical to SEQ ID NO: 3822
  CDS (1)..(993): transl_table=11

SEQ ID NO: 14969 - protein, 330 aa, Novosphingobium aromaticivorans DSM 12444; identical to SEQ ID NO: 3823

SEQ ID NO: 14970 - DNA, 948 bp, Silicibacter sp. TM1040; identical to SEQ ID NO: 3824
  CDS (1)..(948): transl_table=11

SEQ ID NO: 14971 - protein, 315 aa, Silicibacter sp. TM1040; identical to SEQ ID NO: 3825

SEQ ID NO: 14972 - DNA, 972 bp, Mesorhizobium sp. BNC1; identical to SEQ ID NO: 3826
  CDS (1)..(972): transl_table=11

SEQ ID NO: 14973 - protein, 323 aa, Mesorhizobium sp. BNC1; identical to SEQ ID NO: 3827

SEQ ID NO: 14974 - DNA, 990 bp, Clostridium perfringens ATCC 13124; identical to SEQ ID NO: 3828
  CDS (1)..(990): transl_table=11

SEQ ID NO: 14975 - protein, 329 aa, Clostridium perfringens ATCC 13124; identical to SEQ ID NO: 3829

SEQ ID NO: 14976 - DNA, 957 bp, Haemophilus somnus 129PT; identical to SEQ ID NO: 3830
  CDS (1)..(957): transl_table=11

SEQ ID NO: 14977 - protein, 318 aa, Haemophilus somnus 129PT; identical to SEQ ID NO: 3831

SEQ ID NO: 14978 - DNA, 1014 bp, Shewanella sp. MR-7; identical to SEQ ID NO: 3832
  CDS (1)..(1014): transl_table=11

SEQ ID NO: 14979 - protein, 337 aa, Shewanella sp. MR-7; identical to SEQ ID NO: 3833

SEQ ID NO: 14980 - DNA, 1125 bp, Rhizobium leguminosarum bv. viciae 3841; identical to SEQ ID NO: 3834
  CDS (1)..(1125): transl_table=11

SEQ ID NO: 14981 - protein, 374 aa, Rhizobium leguminosarum bv. viciae 3841; identical to SEQ ID NO: 3835

SEQ ID NO: 14982 - DNA, 1014 bp, Shewanella sp. ANA-3; identical to SEQ ID NO: 3836
  CDS (1)..(1014): transl_table=11

SEQ ID NO: 14983 - protein, 337 aa, Shewanella sp. ANA-3; identical to SEQ ID NO: 3837

SEQ ID NO: 14984 - DNA, 957 bp, Haemophilus somnus 2336; identical to SEQ ID NO: 3838
  CDS (1)..(957): transl_table=11

SEQ ID NO: 14985 - protein, 318 aa, Haemophilus somnus 2336; identical to SEQ ID NO: 3839

SEQ ID NO: 14986 - DNA, 942 bp, Haemophilus influenzae R2846; identical to SEQ ID NO: 3840
  CDS (1)..(942): transl_table=11

SEQ ID NO: 14987 - protein, 313 aa, Haemophilus influenzae R2846; identical to SEQ ID NO: 3841

SEQ ID NO: 14988 - DNA, 942 bp, Haemophilus influenzae R2866; identical to SEQ ID NO: 3842
  CDS (1)..(942): transl_table=11

SEQ ID NO: 14989 - protein, 313 aa, Haemophilus influenzae R2866; identical to SEQ ID NO: 3843

SEQ ID NO: 14990 - DNA, 945 bp, Sulfitobacter sp. EE-36; identical to SEQ ID NO: 3844
  CDS (1)..(945): transl_table=11

SEQ ID NO: 14991 - protein, 314 aa, Sulfitobacter sp. EE-36; identical to SEQ ID NO: 3845

SEQ ID NO: 14992 - DNA, 975 bp, Oceanicola batsensis HTCC2597; identical to SEQ ID NO: 3846
  CDS (1)..(975): transl_table=11

SEQ ID NO: 14993 - protein, 324 aa, Oceanicola batsensis HTCC2597; identical to SEQ ID NO: 3847

SEQ ID NO: 14994 - DNA, 960 bp, Pseudoalteromonas tunicata D2; identical to SEQ ID NO: 3848
  CDS (1)..(960): transl_table=11

SEQ ID NO: 14995 - protein, 319 aa, Pseudoalteromonas tunicata D2; identical to SEQ ID NO: 3849

SEQ ID NO: 14996 - DNA, 921 bp, Photobacterium sp. SKA34; identical to SEQ ID NO: 3850
  CDS (1)..(921): transl_table=11

SEQ ID NO: 14997 - protein, 306 aa, Photobacterium sp. SKA34; identical to SEQ ID NO: 3851

SEQ ID NO: 14998 - DNA, 918 bp, Photobacterium sp. SKA34; identical to SEQ ID NO: 3852
  CDS (1)..(918): transl_table=11

SEQ ID NO: 14999 - protein, 305 aa, Photobacterium sp. SKA34; identical to SEQ ID NO: 3853

SEQ ID NO: 15000 - DNA, 948 bp, Xanthobacter autotrophicus Py2; identical to SEQ ID NO: 3854
  CDS (1)..(948): transl_table=11

SEQ ID NO: 15001 - protein, 315 aa, Xanthobacter autotrophicus Py2; identical to SEQ ID NO: 3855

SEQ ID NO: 15002 - DNA, 1050 bp, Vibrio sp. Ex25; identical to SEQ ID NO: 3856
  CDS (1)..(1050): transl_table=11

SEQ ID NO: 15003 - protein, 349 aa, Vibrio sp. Ex25; identical to SEQ ID NO: 3857

SEQ ID NO: 15004 - DNA, 948 bp, Alteromonadales bacterium TW-7; identical to SEQ ID NO: 3858
  CDS (1)..(948): transl_table=11

SEQ ID NO: 15005 - protein, 315 aa, Alteromonadales bacterium TW-7; identical to SEQ ID NO: 3859

SEQ ID NO: 15006 - DNA, 1576 bp, Escherichia coli O6; identical to SEQ ID NO: 3860
  CDS (118)..(1140): transl_table=11

SEQ ID NO: 15007 - protein, 340 aa, Escherichia coli O6; identical to SEQ ID NO: 3861

SEQ ID NO: 15008 - DNA, 942 bp, Haemophilus influenzae; identical to SEQ ID NO: 3862
  CDS (1)..(942): transl_table=11

SEQ ID NO: 15009 - protein, 313 aa, Haemophilus influenzae; identical to SEQ ID NO: 3863

SEQ ID NO: 15010 - DNA, 24 bp, Artificial sequence
  primer
atgtttcagcagcaaaaagactgg

SEQ ID NO: 15011 - DNA, 24 bp, Artificial sequence
  primer
ttaaacctctgtagagcggtttcc

SEQ ID NO: 15012 - protein, 275 aa, Artificial sequence; identical to SEQ ID NO: 3866
  consensus sequence
  Variant (3)..(3): Xaa in position 3 is any amino acid
  Variant (5)..(7): Xaa in position 5 to 7 is any amino acid
  Variant (10)..(10): Xaa in position 10 is any amino acid
  Variant (12)..(19): Xaa in position 12 to 19 is any amino acid
  Variant (21)..(22): Xaa in position 21 to 22 is any amino acid
  Variant (24)..(26): Xaa in position 24 to 26 is any amino acid
  Variant (28)..(28): Xaa in position 28 is any amino acid
  Variant (33)..(33): Xaa in position 33 is any amino acid
  Variant (35)..(35): Xaa in position 35 is any amino acid
  Variant (37)..(41): Xaa in position 37 to 41 is any amino acid
  Variant (42)..(44): Xaa in position 42 to 44 is any or no amino acid
  Variant (46)..(49): Xaa in position 46 to 49 is any amino acid
  Variant (51)..(52): Xaa in position 51 to 52 is any amino acid
  Variant (54)..(55): Xaa in position 54 to 55 is any amino acid
  Variant (57)..(76): Xaa in position 57 to 76 is any amino acid
  Variant (77)..(79): Xaa in position 77 to 79 is any or no amino acid
  Variant (82)..(82): Xaa in position 82 is any amino acid
  Variant (84)..(104): Xaa in position 84 to 104 is any amino acid
  Variant (105)..(106): Xaa in position 105 to 106 is any or no amino acid
  Variant (108)..(149): Xaa in position 108 to 149 is any amino acid
  Variant (150)..(155): Xaa in position 150 to 155 is any or no amino acid
  Variant (157)..(157): Xaa in position 157 is any amino acid
  Variant (160)..(163): Xaa in position 160 to 163 is any amino acid
  Variant (165)..(175): Xaa in position 165 to 175 is any amino acid
  Variant (177)..(180): Xaa in position 177 to 180 is any amino acid
  Variant (182)..(182): Xaa in position 182 is any amino acid
  Variant (184)..(186): Xaa in position 184 to 186 is any amino acid
  Variant (188)..(205): Xaa in position 188 to 205 is any amino acid
  Variant (206)..(209): Xaa in position 206 to 209 is any or no amino acid
  Variant (211)..(211): Xaa in position 211 is any amino acid
  Variant (213)..(221): Xaa in position 213 to 221 is any amino acid
  Variant (223)..(244): Xaa in position 223 to 244 is any amino acid
  Variant (245)..(254): Xaa in position 245 to 254 is any or no amino acid
  Variant (257)..(259): Xaa in position 257 to 259 is any amino acid
  Variant (261)..(261): Xaa in position 261 is any amino acid
  Variant (263)..(264): Xaa in position 263 to 264 is any amino acid
  Variant (266)..(274): Xaa in position 266 to 274 is any amino acid

SEQ ID NO: 15013 - protein, 21 aa, Artificial sequence
  protein pattern
  Variant (2)..(2): Xaa in position 2 is any amino acid
  Variant (3)..(7): Xaa in position 3 to 7 is any or no amino acid
  Variant (9)..(9): Xaa in position 9 is His or Trp
  Variant (14)..(14): Xaa in position 14 is any amino acid
  Variant (15)..(15): Xaa in position 15 is Ala or Ser
  Variant (16)..(16): Xaa in position 16 is any amino acid
  Variant (18)..(20): Xaa in position 18 to 20 is any amino acid
  Variant (21)..(21): Xaa in position 21 is Asp, Asn, Gln or Thr
GXXXXXXDXRGQGXXXRXXXX

SEQ ID NO: 15014 - DNA, 438 bp, ESCHERICHIA COLI
  CDS (1)..(438): transl_table=11
atggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaactacgccaggccgcggagtcgatgaagcgttcctacgttgcaaacgatcctgaaaaggcgagcgatgaagcgcacaccatccataacccggtggtgaaagataatgaagctgcgcatgagggcgtaacgcctgccgctgcacaaacgcaggccagttcgccggaacagaagccagaaaccacgccagagccggtggtaaaacctgctgcggacgctgaaccgaaaaccgctgcaccttccccttcgtcgagtgataaaccgtaa

SEQ ID NO: 15015 - protein, 145 aa, ESCHERICHIA COLI
MAVKTVAGWIRALRSLATTVQNELTQELKLQEFQDSLKKVEKASLTNLTPELKASMDELRQAAESMKRSYVANDPEKASDEAHTIHNPVVKDNEAAHEGVTPAAAQTQASSPEQKPETTPEPVVKPAADAEPKTAAPSPSSSDKP

SEQ ID NO: 15016 - DNA, 537 bp, Klebsiella pneumoniae subsp. pneumoniae MGH 78578
  CDS (1)..(537): transl_table=11
gtgttcgatattggttttagtgaactactgctggtgtttgtgattggcctcattgttctggggccacagcggcttcccgtagcggttaaaacggtagttggctggatccgtacgttacgctcgctggcgaccacggtacaaaatgagctggcccaggagctaaaactgcaggagttccaggagagcctgaagaaggtggaaaaggctagcctgaataacctgacgccggagctgaaagcctcgatggatgaactgcgcgaggccgcggagtcgatgaagcgctcctatagcgcccacgatcccgaaaaagccagcgacgaagccaataccatccttaatccggtggtcaaaggcagcgaagcgcagcgccaggacgtcacgccggcgacggcagaacatcaggccagcgctccggctcatgcgccagatcccgttgccgccgagcaatctgcttcaccggctgaccttcaggcagagaaaacgtccgctacggcggtagttccccattcttcccccgcatcgagtgataaaccgtaa

SEQ ID NO: 15017 - protein, 178 aa, Klebsiella pneumoniae subsp. pneumoniae MGH 78578
MFDIGFSELLLVFVIGLIVLGPQRLPVAVKTVVGWIRTLRSLATTVQNELAQELKLQEFQESLKKVEKASLNNLTPELKASMDELREAAESMKRSYSAHDPEKASDEANTILNPVVKGSEAQRQDVTPATAEHQASAPAHAPDPVAAEQSASPADLQAEKTSATAVVPHSSPASSDKP

SEQ ID NO: 15018 - DNA, 549 bp, Salmonella enterica subsp. arizonae serovar 62:z4,z23:--
  CDS (1)..(549): transl_table=11
gtgtttgatatcggttttagcgaactgctgttagtgttcgttatcggcctcattgtgttggggccgcaacgattaccagtagcggtaaaaacggtagcgggctggattcgcgcgttgcggtcccttgcgacaacggttcagaatgaactgactcaggagctgaaacttcaggagttccaggacagtctgaaaaaagtcgaaaaggcgagcctggaaaacctgactcccgaactgaaagcatctatggatgaactgcgtcaggctgcagagtcgatgaaacgcacctacagcgctaacgatcccgaacaagcgagcgatgaagcgcataccatccataatccggtagtaaaagggaatgaaacgcagcatgagggcgtcacccctgccgccgctgaaacacaggcgagcgcgccggaacaaaagccggagtccgttaaagctaacgcgcctgagtcgacggaaaccgcttccgtagccacgatagacgccgagaagaaatccgccgcgcctgttgtcgaatcttccccctcgtcaagtgataaaccgtaa

SEQ ID NO: 15019 - protein, 182 aa, Salmonella enterica subsp. arizonae serovar 62:z4,z23:--
MFDIGFSELLLVFVIGLIVLGPQRLPVAVKTVAGWIRALRSLATTVQNELTQELKLQEFQDSLKKVEKASLENLTPELKASMDELRQAAESMKRTYSANDPEQASDEAHTIHNPVVKGNETQHEGVTPAAAETQASAPEQKPESVKANAPESTETASVATIDAEKKSAAPVVESSPSSSDKP

SEQ ID NO: 15020 - DNA, 474 bp, Colwellia psychrerythraea 34H
  CDS (1)..(474): transl_table=11
atgtttgacgttggcttttgggaattaatcctcatagcaattatgggcttagttattttaggccctgaacgcttaccggttgcaattcgtactcttcgtggctggatatctggtgctcgaaaatttagtgatactgttaaatctgagcttacagaagaattacgcatacacgaattacatgcaaatttaaaaaaagcagaagaaagtaacttagaaaatttaagtcctgaggttgctgcgtcattgaaatcgttgcaagaagcagccgactctgtggctgagcctttcaaaaaggtcgacagacaaccactagaatcaatgatcgcttcttccttagcttcagctccgcaagctaaagtagagccggagatggctcaagatagtgaagagccaaaaatttcaagtgctccgatagaaaatgaaaaaaaaccagatcagctagttaatccagaaagtgataaacctcagccatga

SEQ ID NO: 15021 - protein, 157 aa, Colwellia psychrerythraea 34H
MFDVGFWELILIAIMGLVILGPERLPVAIRTLRGWISGARKFSDTVKSELTEELRIHELHANLKKAEESNLENLSPEVAASLKSLQEAADSVAEPFKKVDRQPLESMIASSLASAPQAKVEPEMAQDSEEPKISSAPIENEKKPDQLVNPESDKPQP

SEQ ID NO: 15022 - DNA, 561 bp, Haemophilus influenzae R2866
  CDS (1)..(561): transl_table=11
atgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaagtgcggctgaaaatgcagaaaagtctcaaaatgcaatctcagttgaggaggctgcagaaactttatctgaagcagaaaaaacacctacagatttgaccgcacttgaaactcacgagaaagtagaactgaacacacatttatctagctattatcctcctgatgatattgaaatcgctccagcgtcaaaatctcaatcttcaaaaactaaatcatag

SEQ ID NO: 15023 - protein, 186 aa, Haemophilus influenzae R2866
MFDIGFSELILLMVLGLVVLGPKRLPIAIRTVMDWVKTIRGLAANVQNELKQELKLQELQDSIKKAESLNLQALSPELSKTVEELKAQADKMKAELEDKAAQAGTTVEDQIKEIKSAAENAEKSQNAISVEEAAETLSEAEKTPTDLTALETHEKVELNTHLSSYYPPDDIEIAPASKSQSSKTKS

SEQ ID NO: 15024 - DNA, 435 bp, Providencia stuartii
  CDS (1)..(435): transl_table=11
atgcgttcattagcctccaatgtgcaaaatgaattgtcacaagaactcaaattgcaagagttacaagacacgttgaaaaaagttcaggaaaaagcgggtatggaaacgctttcccctgaactgaaacaatctatggatgagcttcgccaagctgcacaatcattaaaaacaggatatcactcgacaacagagagcgttgcaagtgagctacaaaaagcaaaagagttaactgataactacgacaatgcagttaaagatgctcaaaataaagcttcgcaaccaccagagtctgaatcggatcctgatcctgaatatgcagcaaaaatggcagctgtcgtcgatgagccgacaaagccatcgctaaacaatgacagcgaccagcaaaatggcgttacagagaaaaaaaatcctaatcagacagaaagcgaaaaatag

SEQ ID NO: 15025 - protein, 144 aa, Providencia stuartii
MRSLASNVQNELSQELKLQELQDTLKKVQEKAGMETLSPELKQSMDELRQAAQSLKTGYHSTTESVASELQKAKELTDNYDNAVKDAQNKASQPPESESDPDPEYAAKMAAVVDEPTKPSLNNDSDQQNGVTEKKNPNQTESEK

SEQ ID NO: 15026 - DNA, 543 bp, Enterobacter cloacae
  CDS (1)..(543): transl_table=11
gtgttcgacattggttttagtgagctgctgctggtctttgtgattggcctcatcgtgctggggccacagcgtttacccgttgcagtcaaaacggttgtggggtgggtgcgtgcgcttcgttcgctggcatccaccgtacagaacgagctggcgcaggaacttaagctgcaggagtttcaggaaagcctgaaaaaggttgagaaggcgagcatggataacctgacgccggaactgaaagcctccatggatgaactgcgcgaagcggcagaatccatgaagcgctcgtacagcgttaacgatcctgaaaaagcgagcgatgaagcgaacaccatccataacccggtggtgaaaaatagtgaagcgcagcgcgagggcgtaacgcctgccagcgcggagcatcaggccaccgcgcctgaacatacgccgcaggaacctgaactgaaaaaacaggcgcagccggaagaccctgtggtcaacgcggctgcagcaaagcccgccgcgcctgttaccgaatcatccccctcgtcgagtgataaagcgtaa

SEQ ID NO: 15027 - protein, 180 aa, Enterobacter cloacae
MFDIGFSELLLVFVIGLIVLGPQRLPVAVKTVVGWVRALRSLASTVQNELAQELKLQEFQESLKKVEKASMDNLTPELKASMDELREAAESMKRSYSVNDPEKASDEANTIHNPVVKNSEAQREGVTPASAEHQATAPEHTPQEPELKKQAQPEDPVVNAAAAKPAAPVTESSPSSSDKA

SEQ ID NO: 15028 - DNA, 594 bp, Erwinia carotovora subsp
  CDS (1)..(594): transl_table=11
gtgttcgatatcggttttggtgaattgctattggtgatggttctcggcctgatagtccttgggcctgagcgtttgcctgttgccgtcagaacggttgcaagctggatcaggacgctgcgttcactggcgtctacggttcagaatgagctgtcccaggagctgaaactccaggaatttcaggaaagcctgaagaaagtcgaaaaagccagtttgcagaatctgtcgcctgagttgaaagcttcaatggatgaactcaaagatgcggcagaagcgatgaaacgtggctataccgagacaccgtcaccgcaaaaatcagacgatcccaaaaaatcaggtgatcatagtgcgaccgtggaaccgcagagcaatatcccgttaaacgatcctgaagcggcctacgatggggtgattgaagcggaaaccgcagtacgtccggcagacagccagcagaagcctgagaacgctgctgttgctgagaatcataatgatggccgccacgccacaagtgatgaagctgtcggtaacaataatgtcaaacctgagcagtcccagccttctgctgcttctgcccgccaaccgagcgatagtcgttag

SEQ ID NO: 15029 - protein, 197 aa, Erwinia carotovora subsp
MFDIGFGELLLVMVLGLIVLGPERLPVAVRTVASWIRTLRSLASTVQNELSQELKLQEFQESLKKVEKASLQNLSPELKASMDELKDAAEAMKRGYTETPSPQKSDDPKKSGDHSATVEPQSNIPLNDPEAAYDGVIEAETAVRPADSQQKPENAAVAENHNDGRHATSDEAVGNNNVKPEQSQPSAASARQPSDSR

SEQ ID NO: 15030 - DNA, 561 bp, Haemophilus influenzae
  CDS (1)..(561): transl_table=11
gtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaaatgcggctgaaaatgcagaaaaacctcaaaatgcaatctcagttgaggaggctgcagaaactttatctgaagcagaaaaaacacctacagatttgaccgcacttgaaactcacgagaaagtagaactgaacacacatttatctagctattatcctcctgatgatattgaaatcgctccagcgtcaaaatctcaatcttcaaaaactaaatcatag

SEQ ID NO: 15031 - protein, 186 aa, Haemophilus influenzae
MFDIGFSELILLMVLGLVVLGPKRLPIAIRTVMDWVKTIRGLAANVQNELKQELKLQELQDSIKKAESLNLQALSPELSKTVEELKAQADKMKAELEDKAAQAGTTVEDQIKEIKNAAENAEKPQNAISVEEAAETLSEAEKTPTDLTALETHEKVELNTHLSSYYPPDDIEIAPASKSQSSKTKS

SEQ ID NO: 15032 - DNA, 555 bp, Haemophilus somnus
  CDS (1)..(555): transl_table=11
gtgtttgatattggtttctccgaacttgttttactttttgttgtgggcttgatagtactgggaccacagcgtttgcctgtagctgttcgtacggtaatgggttgggtaaggactgtgcgaagcttagcgacaaatgtacaaaatgaacttagtcaggaattaaaactgaaagagttacaagaaagcattaaaaaagctgaagatctcaatatttcccaattatctccggaacttagtgaaaccgtagaagaattacgtcaatcagcacaaaaaattaaaatgaatttagaggagaaagctgctgaaacaaattcttctgttgaagagcaggtgcaagaactgaaaagtgcggtgcaaaattcacagggtactgcaacgactgaaatagaaaaaaattttgattttccttctggtgagttatctcctgctgaacttgcagagttagctgaggaaggagagcctatgctggaaatgggagaatctgatttttcagaggatgagcaggcgactgcttcatctaacgaaaccattgaaaatatcaaagaaaaagtatga

SEQ ID NO: 15033 - protein, 184 aa, Haemophilus somnus
MFDIGFSELVLLFVVGLIVLGPQRLPVAVRTVMGWVRTVRSLATNVQNELSQELKLKELQESIKKAEDLNISQLSPELSETVEELRQSAQKIKMNLEEKAAETNSSVEEQVQELKSAVQNSQGTATTEIEKNFDFPSGELSPAELAELAEEGEPMLEMGESDFSEDEQATASSNETIENIKEKV

SEQ ID NO: 15034 - DNA, 576 bp, Pasteurella multocida
  CDS (1)..(576): transl_table=11
atgtttgatattgggttttctgagttatttcttattttagtcatcggtctgcttgtgctcggaccgaaacgtttgcctgtggcaattcgcaccgtcatgggctgggttgcaacaattcgtggtttagcctccaatgtgcaaaatgaactaaaacaagaactgaaattacaagagctgcaagaaagcataaaaaaagcagaagaactcaatttccaacaactctcgcctgaactcagtaaaacggttgaagaattgaaagcctcggctgaaaaaatgcgtaccgcgctagaacaaaaagccgcagcgaccaatacaacactggaagaacagatcaaagagataaaaaatgcaacagagagcacatcacaaacactgacggagcaactcaccccgtctgaacaagtgacggaggcaacaaccgatgatgtcctgtctcctgcagaacaagcagaacttgccgaagaaaacgatgaaatggtttatatccagcaatattatcccgatgacgatgatgagccggtatttgcctcaaaagtaaaacctcaaacagaagaaatacaagataagaaagcctaa

SEQ ID NO: 15035 - protein, 191 aa, Pasteurella multocida
MFDIGFSELFLILVIGLLVLGPKRLPVAIRTVMGWVATIRGLASNVQNELKQELKLQELQESIKKAEELNFQQLSPELSKTVEELKASAEKMRTALEQKAAATNTTLEEQIKEIKNATESTSQTLTEQLTPSEQVTEATTDDVLSPAEQAELAEENDEMVYIQQYYPDDDDEPVFASKVKPQTEEIQDKKA

SEQ ID NO: 15036 - DNA, 444 bp, Photorhabdus luminescens subsp
  CDS (1)..(444): transl_table=11
gtgtttgacattggttttggtgagttgctgctggttatggtcattggcttggtggttttggggccagagcggctaccggtggctgtaaaaacggttgctggttggatcagggcactgcgctctttagctgctaacgtccaaaatgagttggtccaagagctgaaattgcaggagctccaggaaagcctgaaaaaagttcaagaagaagcggggttgcagaatttatccccggaactaaaagcttcgatggatgaactaaaagaagctgctgagtctttgaaaaaagcataccaaaatgaacctgatgcagggagcatgaaagcatcagaaataaatgaggtggcacaaaagccggcagcgtctcaggttgtggcttcatctggaccttctgctctagtggatgatcaagcggcttctgcaacgaagaaaaaaacttccgattaa

SEQ ID NO: 15037 - protein, 147 aa, Photorhabdus luminescens subsp
MFDIGFGELLLVMVIGLVVLGPERLPVAVKTVAGWIRALRSLAANVQNELVQELKLQELQESLKKVQEEAGLQNLSPELKASMDELKEAAESLKKAYQNEPDAGSMKASEINEVAQKPAASQVVASSGPSALVDDQAASATKKKTSD

SEQ ID NO: 15038 - DNA, 549 bp, Salmonella choleraesuis
  CDS (1)..(549): transl_table=11
gtgtttgatatcggttttagcgaactgctgttagtgttcgttatcggcctcattgtgttggggccgcaacgattgccagtagcggtaaaaacggtagcgggctggattcgcgcgttgcgatcccttgcgacaacggttcagaatgaactgactcaggaactgaaacttcaggagttccaggacagtctgaaaaaagtcgaaaaggcgagcctggaaaatctgactcccgaactgaaagcatctatggatgaactgcgtcaggcggcggagtcgatgaaacgcacctacagcgctaacgatcccgaacaagcgagcgatgaagcgcataccatccataatccggtggtaaaagggaacgaaacgcagcatgagggcgtcacccctgccgccgctgaaacacaggcgagcgcgccggaacaaaagccggagcccgttaaagctaacgtgcctgagtcgacggaaaccgcttccgtagccacgatagacgccgagaagaaatccgctgcgcctgttgtcgaatcttccccctcgtcgagtgataaaccgtaa

SEQ ID NO: 15039 - protein, 182 aa, Salmonella choleraesuis
MFDIGFSELLLVFVIGLIVLGPQRLPVAVKTVAGWIRALRSLATTVQNELTQELKLQEFQDSLKKVEKASLENLTPELKASMDELRQAAESMKRTYSANDPEQASDEAHTIHNPVVKGNETQHEGVTPAAAETQASAPEQKPEPVKANVPESTETASVATIDAEKKSAAPVVESSPSSSDKP

SEQ ID NO: 15040 - DNA, 549 bp, Salmonella typhi
  CDS (1)..(549): transl_table=11
gtgtttgatatcggttttagcgaactgctgttagtgttcgttatcggcctcattgtgttggggccgcaacgattgccagtagcggtaaaaacggtagcgggctggattcgcgcgttgcgctcccttgcgacaacggttcagaatgaactgactcaggaactgaaacttcaggagttccaggacagtctgaaaaaagtcgaaaaggcgagcctggaaaatctgactcccgaactgaaagcatctatggatgaactgcgtcaggcggcggagtcgatgaaacgcacctacagcgctaacgatcccgaacaagcgagcgatgaagcgcataccatccataatccggtggtaaaagggaacgaaacgcagcatgagggcgtcacccctgccgccgctgaaacacaggcgagcgcgccggaacaaaagccggagcccgttaaagctaacgtgcctgagtcgacggaaaccgcttccgtagccgcgatagacgccgagaagaaatccgctgcgcctgttgtcgaatcttccccctcgtcgagtgataaaccgtaa

SEQ ID NO: 15041 - protein, 182 aa, Salmonella typhi
MFDIGFSELLLVFVIGLIVLGPQRLPVAVKTVAGWIRALRSLATTVQNELTQELKLQEFQDSLKKVEKASLENLTPELKASMDELRQAAESMKRTYSANDPEQASDEAHTIHNPVVKGNETQHEGVTPAAAETQASAPEQKPEPVKANVPESTETASVAAIDAEKKSAAPVVESSPSSSDKP

SEQ ID NO: 15042 - DNA, 450 bp, Shewanella oneidensis
  CDS (1)..(450): transl_table=11
atgtttgacggtatcggctttatggagctgctgctgatcggtgttttggggctaatagttcttggccccgaacgtctaccggttgcagtacgttcagtaaccagttgggtccgcgcgatgaaacgcatggccaactcagtcaaagaagaacttgagcaagagctaaagatcgagcagttgcacgccgacctcaaaaaagcggagagtaaaggcctatctaacctctcacccgaactgcaagaatcaatcgagcagttgaaacaagccgcgcagtctgtgaatcgtccttaccaagtgcaagatactcccagtgcacaggataaccagatccacaaccctgcaagccaaactgtttctacagaggcgagctctacttcggcttcttccgcccccaaaagtgagtccattcagggcgaggatccccgttctaacacgaaagctaacggataa

SEQ ID NO: 15043 - protein, 149 aa, Shewanella oneidensis
MFDGIGFMELLLIGVLGLIVLGPERLPVAVRSVTSWVRAMKRMANSVKEELEQELKIEQLHADLKKAESKGLSNLSPELQESIEQLKQAAQSVNRPYQVQDTPSAQDNQIHNPASQTVSTEASSTSASSAPKSESIQGEDPRSNTKANG

SEQ ID NO: 15044 - DNA, 444 bp, Shewanella sp
  CDS (1)..(444): transl_table=11
atgtttgacggtatcggctttatggagctgctgctgatcggtgttctggggcttgtggtacttggccccgaacgtctaccggttgcagtacgttcagtaacaagttggatccgcgcgatgaaacgcatggccaactcagtcaaagaagaacttgagcaagagctaaagatcgagcagttgcacgccgacctcaaaaaagcagagagtaaaggtctatctaacctctcacccgaactgcaagagtcgatcgaccagttaaagcaagcagcacagtctgtgaatcgtccttaccaagtgcaagatgttcccgcaccggaaaaccagatccacaaccctgcgagccagagtgtttctacagaggcgagtccttcggcttcctccgcccccactagcgaatccaatcagggcgaggatacccgttccaacccgaaagctaacggataa

SEQ ID NO: 15045 - protein, 147 aa, Shewanella sp
MFDGIGFMELLLIGVLGLVVLGPERLPVAVRSVTSWIRAMKRMANSVKEELEQELKIEQLHADLKKAESKGLSNLSPELQESIDQLKQAAQSVNRPYQVQDVPAPENQIHNPASQSVSTEASPSASSAPTSESNQGEDTRSNPKANG

SEQ ID NO: 15046 - DNA, 444 bp, Shewanella sp
  CDS (1)..(444): transl_table=11
atgtttgacggtatcggctttatggagctgctgctgatcggtgttctggggcttgtggtacttggccccgaacgtctaccggttgcagtacgttcagtaacaggttggatccgcgcgatgaaacgcatggccaactcagtcaaagaagaacttgagcaagagctaaagatcgagcaattgcacgccgacctcaaaaaagcagagagcaaaggtctatctaacctctcacccgaactgcaagagtcgatcgaccagttgaagcaagcagcgcagtctgtgaatcgtccttaccaagtgcaagatattcctgcacaggaaaatcagatccacaatcctgcaagccagagtgtttcttcagaggcgagtcctacggcttcctccgcccccactagcgaacccaatcagggcgaggatacccgttctaacccgaaagctaacggataa

SEQ ID NO: 15047 - protein, 147 aa, Shewanella sp
MFDGIGFMELLLIGVLGLVVLGPERLPVAVRSVTGWIRAMKRMANSVKEELEQELKIEQLHADLKKAESKGLSNLSPELQESIDQLKQAAQSVNRPYQVQDIPAQENQIHNPASQSVSSEASPTASSAPTSEPNQGEDTRSNPKANG

SEQ ID NO: 15048 - DNA, 663 bp, Yersinia pseudotuberculosis
  CDS (1)..(663): transl_table=11
gtgttcgatatcgggtttagtgaactgctactggtccttgtaattggtctggtcgtacttgggccggagcgattacctgtcgccgtaagaactgtttctggctggattcgtacattgcgttcgcttgcggccactgtacaaaacgaactggcacaagagctaaaactacaagagttacaagacagcctgaaaaaagtagagcaggccggcttacaaaatctgacgcctgaattgaaggcgtcgatggatgaactcaaagaggccgcagaggcgctaaaacgttcttatcatgttgatgctggatcagaagctccacatacgatccataacccattggtgacagagccggaagcgatccacgacggtgttacgccagcggagccagcaacacaggtttccgcattggcacaggcccctaatatacttgaggcagggacagcgtcagtggctgactctgtagtcgaagctgcacctgttactaccgtgaaatcggtggttcagggggaggtattggttaagtcgactccagtacaagaagtagggttggcagatgttatggataaacccgtaaccaagcagcaaatcgatacaatcgattcccatggcacggatttatccagtgctggcccatctcgtattcaccaacctggcggcgatcagtaa

SEQ ID NO: 15049 - protein, 220 aa, Yersinia pseudotuberculosis
MFDIGFSELLLVLVIGLVVLGPERLPVAVRTVSGWIRTLRSLAATVQNELAQELKLQELQDSLKKVEQAGLQNLTPELKASMDELKEAAEALKRSYHVDAGSEAPHTIHNPLVTEPEAIHDGVTPAEPATQVSALAQAPNILEAGTASVADSVVEAAPVTTVKSVVQGEVLVKSTPVQEVGLADVMDKPVTKQQIDTIDSHGTDLSSAGPSRIHQPGGDQ

SEQ ID NO: 15050 - DNA, 23 bp, Artificial sequence
  primer
atggcggtaaaaacggtagcggg

SEQ ID NO: 15051 - DNA, 24 bp, Artificial sequence
  primer
ttacggtttatcactcgacgaagg

SEQ ID NO: 15052 - protein, 91 aa, Artificial sequence
  consensus sequence
  Variant (4)..(4): Xaa in position 4 is any amino acid
  Variant (8)..(8): Xaa in position 8 is any amino acid
  Variant (11)..(11): Xaa in position 11 is any amino acid
  Variant (13)..(14): Xaa in position 13 to 14 is any amino acid
  Variant (16)..(16): Xaa in position 16 is any amino acid
  Variant (19)..(19): Xaa in position 19 is any amino acid
  Variant (24)..(24): Xaa in position 24 is any amino acid
  Variant (28)..(28): Xaa in position 28 is any amino acid
  Variant (30)..(32): Xaa in position 30 to 32 is any amino acid
  Variant (34)..(35): Xaa in position 34 to 35 is any amino acid
  Variant (37)..(37): Xaa in position 37 is any amino acid
  Variant (38)..(40): Xaa in position 38 to 40 is any or no amino acid
  Variant (42)..(43): Xaa in position 42 to 43 is any amino acid
  Variant (45)..(46): Xaa in position 45 to 46 is any amino acid
  Variant (48)..(49): Xaa in position 48 to 49 is any amino acid
  Variant (52)..(52): Xaa in position 52 is any amino acid
  Variant (57)..(58): Xaa in position 57 to 58 is any amino acid
  Variant (60)..(64): Xaa in position 60 to 64 is any amino acid
  Variant (67)..(67): Xaa in position 67 is any amino acid
  Variant (69)..(74): Xaa in position 69 to 74 is any amino acid
  Variant (75)..(75): Xaa in position 75 is any or no amino acid
  Variant (77)..(77): Xaa in position 77 is any amino acid
  Variant (81)..(86): Xaa in position 81 to 86 is any amino acid
  Variant (88)..(90): Xaa in position 88 to 90 is any amino acid
MFDXIGFXELXLXXVXGLXVLGPXRLPXAXXXVXXWXXXXRXXAXXVXXELXQELKXXEXXXXXKKXEXXXXXXXLXPELXXXXXXLXXXA

SEQ ID NO: 15053 - protein, 22 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (8)..(8): Xaa in position 8 is any or no amino acid
  Variant (10)..(10): Xaa in position 10 is Ile or Val
  Variant (11)..(11): Xaa in position 11 is Lys or Arg
  Variant (12)..(12): Xaa in position 12 is Ala or Thr
  Variant (13)..(13): Xaa in position 13 is Ile, Leu, Met or Val
  Variant (14)..(14): Xaa in position 14 is Lys or Arg
  Variant (15)..(15): Xaa in position 15 is any amino acid
  Variant (16)..(16): Xaa in position 16 is Leu or Met
  Variant (18)..(18): Xaa in position 18 is Ala, Asn, Ser or Thr
  Variant (19)..(19): Xaa in position 19 is Asn, Ser or Thr
  Variant (21)..(21): Xaa in position 21 is any amino acid
  Variant (22)..(22): Xaa in position 22 is Glu or Asn
AXXXXVXXWXXXXXXXAXXVXX

SEQ ID NO: 15054 - protein, 15 aa, Artificial sequence
  protein pattern
  Variant (2)..(2): Xaa in position 2 is any or no amino acid
  Variant (4)..(4): Xaa in position 4 is Ala, Ile or Leu
  Variant (5)..(5): Xaa in position 5 is any amino acid
  Variant (6)..(6): Xaa in position 6 is Glu or Gln
  Variant (7)..(7): Xaa in position 7 is Phe or Leu
  Variant (8)..(8): Xaa in position 8 is any amino acid
  Variant (9)..(9): Xaa in position 9 is Ala, Asp or Glu
  Variant (10)..(10): Xaa in position 10 is Asp or Ser
  Variant (11)..(11): Xaa in position 11 is Ile or Leu
  Variant (14)..(14): Xaa in position 14 is Ala or Val
  Variant (15)..(15): Xaa in position 15 is Glu or Gln
EXKXXXXXXXXKKXX

SEQ ID NO: 15055 - protein, 19 aa, Artificial sequence
  protein pattern
  Variant (2)..(3): Xaa in position 2 to 3 is any or no amino acid
  Variant (6)..(7): Xaa in position 6 to 7 is any amino acid
  Variant (8)..(8): Xaa in position 8 is Ser or Thr
  Variant (9)..(9): Xaa in position 9 is Ile, Met or Val
  Variant (10)..(10): Xaa in position 10 is Asp or Glu
  Variant (11)..(11): Xaa in position 11 is Glu or Gln
  Variant (13)..(13): Xaa in position 13 is Lys or Arg
  Variant (14)..(14): Xaa in position 14 is Ala, Asp, Glu or Gln
  Variant (15)..(15): Xaa in position 15 is Ala, Gln or Ser
  Variant (17)..(17): Xaa in position 17 is Asp, Glu or Gln
  Variant (18)..(18): Xaa in position 18 is any amino acid
  Variant (19)..(19): Xaa in position 19 is Ile, Leu, Met or Val
LXXELXXXXXXLXXXAXXX

SEQ ID NO: 15056 - DNA, 1461 bp, Saccharomyces cerevisiae
  CDS (1)..(1461)
atgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtctggaagaagaccatacaaaacaaaatcaaggactcgctgaccctatcatcaaaggagaaggagcttctacaccttatcgaacatggcgctgaacaaactactgaaaactcaaacctgttttatgacatatttgaagaaattatcgactctctaccttcagtcagtgattctggaagtttaacccctaaaaacctctatgtaagtaataatagcagtggattgtcagtacattcaaaactgcttacgccaatcactgcttccaacgagaaaaaaattgaaaatttcataaaaactaatgctgcatctcaagccaaaacccccctcatttacgctaagcacatttatgaaaacatagacggctacaagtgcgttccgtcaaagaggcctcttgaacaactttcccccacggaactccaccagggagatcgccccaataaggctagcttttccaacaagaaggcaatcctggagagtgcaaaaaaaatcgaaatagagcagagaaagataatcaacaaataccaaagaatttcccgcatacaagaacatgaaagtaatcctgagttcagttccaattccaattccggttcagagtacgaatcggaggaagaagtagtcccaagatcagccacagtcacacaactccaaagcagaccagtgccatactacaagaataatggaatgccctactcactctccaaagtacgaggaaggcccatgtatccaagacctgctgaagatgcttacaatgccaattatattcaaggtctgccccagtaccaaacatcttatttttcgcagctgttattatcatcaccccagcattacgaacattctccacatcaaaggaactttacgccatccaaccaatcgcatgggaacttttattaa

SEQ ID NO: 15057 - protein, 486 aa, Saccharomyces cerevisiae
MSLKEDDFGKDNSRNIESYTGRIFDVYIQKDSYSQSALDDMFPEAVVSTAACVKNEAEDNINLIDTHPQFELVNTGLGAKSDDLKSPSAKATFTDKQRKNEVPNISVSNYFPGQSSETSSTTESWTIGCDKWSEKVEEAFLEALRLIMKNGTTKIKIRNANFGRNELISLYIKHKTNEFRTKKQISSHIQVWKKTIQNKIKDSLTLSSKEKELLHLIEHGAEQTTENSNLFYDIFEEIIDSLPSVSDSGSLTPKNLYVSNNSSGLSVHSKLLTPITASNEKKIENFIKTNAASQAKTPLIYAKHIYENIDGYKCVPSKRPLEQLSPTELHQGDRPNKASFSNKKAILESAKKIEIEQRKIINKYQRISRIQEHESNPEFSSNSNSGSEYESEEEVVPRSATVTQLQSRPVPYYKNNGMPYSLSKVRGRPMYPRPAEDAYNANYIQGLPQYQTSYFSQLLLSSPQHYEHSPHQRNFTPSNQSHGNFY

SEQ ID NO: 15058 - DNA, 1473 bp, Saccharomyces pastorianus
  CDS (1)..(1473)
atgagtcttaaagtagatgactttggcacagactgctctagaagtatagaaacatacaatgacagaatctttgatgtgtacatacagaaggattcgtattcccagtcgggtctagatggcatgtttccagaacctggtattcggagcgatgcttgtgtgaaaaatgaagcggaagatggcatcgacctcgccaacgcgcctcctcagtttgaactggtcaatactgggctgggagctaaatcagatcgtctaaggtctccatcagtgaagggtgcgttcaccgataaacagaggaaaaatgaagtaccaagcatagctgttaacaattacttttctggacaaagtagcgaaaatacgtcaacaacggaatcttggggcatcggctgcgataagtggtccgaaaaagtggaagaagcattctttgaagctctcaaactgataatgaaaaacggtaccacgaaaataaaaataagaaacgccaatttcggaagaaatgaactcatttcattatacatcaagcatcaaaccaatgagttcagaaccaagaagcaaatttcttcacatatccaagtctggaaaaaaaccatacaaaacaaagttaaggactctttgactttgtcacagagagaggaggagctcttacatctcatcgagcatggtgcagaacaagcagcggaaacttctaatatgttttatgacatattcgaggaaattattgattcattaccttcaattaacgacgcaacgaattcaactcctaataatcttcacgccagtaacaccagtaacaccagtaacaatgaattatcagtacactcaaggttactaacgccaatcacagcttcaaacgagaagaagatagagaatttcatcaaacacaacgctgcatctcaagcgaagactcccttaatctacgctaaacacatttacgaaaacatggacggctataaatgtgtaccatctgaaagacaccttagacagctttctcccgcagaatctcatcacggaggcgttttcgacaaggataagatttcaagtaaggaagctatcttggaaacagccagaaatatcgaaatagagcagaggaagattatcaacaagtaccaaagactatcccgcatacaaggacaagagagtaatacagagttcagttccaattccaattccggttcggaatacgaatctgaagaggaagttgttccaaggtctgctgcagagccacagttacaaggtaggctagcaccatactacaagaacaacggcatgccatatcctctctccaaagtacgaaccaggccaatgtaccccagacctgctgaagacgtctataattcgaactatgctcaaggtctaccccagtaccaatcttcctacttttctcaacttctattatcatcaccccaacatttcgagcattccccacaccaaagaaactttacacagtccaaccaatcgcatgggaacttctattga

SEQ ID NO: 15059 - protein, 490 aa, Saccharomyces pastorianus
MSLKVDDFGTDCSRSIETYNDRIFDVYIQKDSYSQSGLDGMFPEPGIRSDACVKNEAEDGIDLANAPPQFELVNTGLGAKSDRLRSPSVKGAFTDKQRKNEVPSIAVNNYFSGQSSENTSTTESWGIGCDKWSEKVEEAFFEALKLIMKNGTTKIKIRNANFGRNELISLYIKHQTNEFRTKKQISSHIQVWKKTIQNKVKDSLTLSQREEELLHLIEHGAEQAAETSNMFYDIFEEIIDSLPSINDATNSTPNNLHASNTSNTSNNELSVHSRLLTPITASNEKKIENFIKHNAASQAKTPLIYAKHIYENMDGYKCVPSERHLRQLSPAESHHGGVFDKDKISSKEAILETARNIEIEQRKIINKYQRLSRIQGQESNTEFSSNSNSGSEYESEEEVVPRSAAEPQLQGRLAPYYKNNGMPYPLSKVRTRPMYPRPAEDVYNSNYAQGLPQYQSSYFSQLLLSSPQHFEHSPHQRNFTQSNQSHGNFY

SEQ ID NO: 15060 - DNA, 1461 bp, Saccharomyces pastorianus
  CDS (1)..(1461)
atgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacgcgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtctggaagaagaccatacaaaacaaaatcaaggactcgctgaccctatcatcaaaggagaaggagcttctacaccttatcgaacatggcgctgaacaaactactgaaaactcaaacctgttttatgacatatttgaagaaattatcgactctctaccttcagtcagtgattctggaagtttaacccctaaaaacctctatgtaagtaataatagcagtggattgtcagtacattcaaaactgcttacgccaatcactgcttccaacgagaaaaaaattgaaaatttcataaaaactaatgctgcatctcaagccaaaacccccctcatttacgctaagcacatttatgaaaacatagacggctacaagtgcgttccgtcaaagaggcctcttgaacaactttcccccacggaactccaccagggagatcgccccaataaggctagcttttccaacaagaaggcaatcctggagagtgcaaaaaaaatcgaaatagagcagagaaagataatcaacaaataccaaagaatttcccgcatacaagaacatgaaagtaatcctgagttcagttccaattccaattccggttcagagtacgaatcggaggaagaagtagtcccaagatcagccacagtcacacaactccaaagcagaccagtgccatactacaagaataatggaatgccctactcactctccaaagtacgaggaaggcccatgtatccaagacctgctgaagatgcttacaatgccaattatattcaaggtctgccccagtaccaaacatcttatttttcgcagctgttattatcatcaccccagcattacgaacattctccacatcaaaggaactttacgccatccaaccaatcgcatgggaacttttattaa

SEQ ID NO: 15061 - protein, 486 aa, Saccharomyces pastorianus
MSLKEDDFGKDNSRNIESYTGRIFDVYIQKDSYSQSALDDMFPEAVVSTAACVKNEAEDNINLIDAHPQFELVNTGLGAKSDDLKSPSAKATFTDKQRKNEVPNISVSNYFPGQSSETSSTTESWTIGCDKWSEKVEEAFLEALRLIMKNGTTKIKIRNANFGRNELISLYIKHKTNEFRTKKQISSHIQVWKKTIQNKIKDSLTLSSKEKELLHLIEHGAEQTTENSNLFYDIFEEIIDSLPSVSDSGSLTPKNLYVSNNSSGLSVHSKLLTPITASNEKKIENFIKTNAASQAKTPLIYAKHIYENIDGYKCVPSKRPLEQLSPTELHQGDRPNKASFSNKKAILESAKKIEIEQRKIINKYQRISRIQEHESNPEFSSNSNSGSEYESEEEVVPRSATVTQLQSRPVPYYKNNGMPYSLSKVRGRPMYPRPAEDAYNANYIQGLPQYQTSYFSQLLLSSPQHYEHSPHQRNFTPSNQSHGNFY

SEQ ID NO: 15062 - DNA, 25 bp, Artificial sequence
  primer
atgagtcttaaagaagacgactttg

SEQ ID NO: 15063 - DNA, 25 bp, Artificial sequence
  primer
ttaataaaagttcccatgcgattgg

SEQ ID NO: 15064 - DNA, 483 bp, Saccharomyces cerevisiae
  CDS (1)..(483)
atgggtaaatcacacggttacagatctcgtactcgttacatgttccaacgtgacttcagaaagcatggtgccgtccatctttctacttacttgaaggtctacaaggttggtgacattgtcgacatcaaagccaatggttctatccaaaagggtatgccacacaagttttaccaaggtaagaccggtgttgtctacaacgttactaagtcttctgttggtgttatcatcaacaagatggtcggtaacagatatctagaaaaaagattaaacttaagagttgaacacatcaagcactccaagtgtagacaagaatttttggaaagagttaaggccaatgctgctaagcgtgctgaagctaaggctcaaggtgttgctgttcaattgaagagacaaccagctcaaccaagagaatcccgtatcgtttctactgaaggtaacgttcctcaaactttggccccagttccatacgaaactttcatctaa

SEQ ID NO: 15065 - protein, 160 aa, Saccharomyces cerevisiae
MGKSHGYRSRTRYMFQRDFRKHGAVHLSTYLKVYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 15066 - DNA, 857 bp, Zea mays
  CDS (42)..(524)
cgtcaatcctcgaacgaaaaatcgacggcaattaaggcgcgatgggtcactcttacggaaagcgagcgggcactcgatatgccttcagcagggactttcgccagaagggcatgatcgccctgaacacctacctgaaggtgtaccacgtcggtgatatcgtcgacatcaaggtcaacggtgccgtccagaagggcatgcccttcaaggtctaccacggcaagactggtgtcatctacaacgtcaccaagagctctgtcggcgtcattgtctacaagaaggtcaagcaccgctacatcgagaagcgcatcaacgtccgaatcgagcacatccagccctcccgatcccgtgaggacttcatcaagcgagtcaaggccaacgccgaggccaagaagcaggccagagccgatggtgtgactgttcaggtcaagcgacagcccgctcttccccgggaagcccacacggtctccctgaccgacaaccctcctgagactgtcactcctctgccatacgaaactacaatctaagggaagggttggcgtggtgctcgcttcggtttttcttatggtgttgcgttcggatgggaaagaactcagcatgtgaccaaggtctgcatttttttctatttgatgttcataggaaatgagaaaatatgacatcgacaaaagtgcatttttgctcagtggccactcctggttagaggagtagagtatcctcatagtttctacgacttgtgcggtgtctcccatatataatacctaggtgtctgattttcggatacgttgagcgctgaagctaaaaacaaacccttggcgaaatatactggacgttttccatgacaaacgttgaatttccttgat

SEQ ID NO: 15067 - protein, 160 aa, Zea mays
MGHSYGKRAGTRYAFSRDFRQKGMIALNTYLKVYHVGDIVDIKVNGAVQKGMPFKVYHGKTGVIYNVTKSSVGVIVYKKVKHRYIEKRINVRIEHIQPSRSREDFIKRVKANAEAKKQARADGVTVQVKRQPALPREAHTVSLTDNPPETVTPLPYETTI

SEQ ID NO: 15068 - DNA, 782 bp, Zea mays
  CDS (68)..(562)
cctagtcccccccacccaaccacccttctcccgccgccgccccgcgaagcaaagcaggaggagcaggatgccggcgggccacggtctgcggtcgcggacgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccgctcggccctaaacctgggttcatggtcgagggtaccacaattgagaccgtcactcccattccctacgatgtggtcaatgatctcaagggtggttactagggtgtttgggttatctgcctgcacaaccagttcaaatctatggtgctcttatgggttggatttgctctctgagcagtagtctgggttgggtctttattcatgtcaagaagatattcggtgtaggttgctatcatgagttttgcagaaatgctatactgtgctatttcctttagaatgatgatgtgctctgttgaactatatagttacattgcttgcctcc

SEQ ID NO: 15069 - protein, 164 aa, Zea mays
MPAGHGLRSRTRDLFARPFRKKGYIPLTTYLRTYKVGEYVDVKVNGAVHKGMPHKFYHGRTGRVWNVTKRAIGVEINKQVGNRIIRKRIHVRVEHVQPSRCAEEFRLRKVKNDQLKAEAKARGEVISTKRQPLGPKPGFMVEGTTIETVTPIPYDVVNDLKGGY

SEQ ID NO: 15070 - DNA, 684 bp, Triticum aestivum
  CDS (57)..(530)
  misc_feature (677)..(677): n is a, g, c or t
  misc_feature (683)..(683): n is a, g, c or t
ctcgtgccgaattcggcacgaggaacaaacatcaccttcaattcgcattcatcaagatgggtcacccagcaggtcttcgcgcgggcacgcgctatgctttcagccgaaatttccgggagaagggaatgatcaagttgtccacttatttgcgtcaatacaaggtcggagatatagttgatatcaaagcaaatggtgcagttcaaaagggtatgcctcacaaagtctaccatggaaagactggtgtaatctacaacgtcacaaaaaatgctgtcggtgttattatctacaaaaaagtcaagcacagatatattgaaaagcgtgtcaacctcagaattgagcacgtttcgctatcacgatcacgagaagagttcgtaaggcgtgtcaaggctaatgccgagttgaagaagaaatccaaggcagaaggaactcacgtgttcctaaagagacaaccgcttcaaccccgggaagcaagaaccatttcgatgaaaggacaatgtaccaagaaacagtcgttaccgattgcatattgagaccccacttatttggtcatcggtgcagttttcgtccggggcgggggttggcggggtgccctcctttttccgagtgggtcaatctagccacagccggcacccgggccgtcgcgagggccggccccggttacccaatttcccccctantagtgng

SEQ ID NO: 15071 - protein, 157 aa, Triticum aestivum
MGHPAGLRAGTRYAFSRNFREKGMIKLSTYLRQYKVGDIVDIKANGAVQKGMPHKVYHGKTGVIYNVTKNAVGVIIYKKVKHRYIEKRVNLRIEHVSLSRSREEFVRRVKANAELKKKSKAEGTHVFLKRQPLQPREARTISMKGQCTKKQSLPIAY

SEQ ID NO: 15072 - DNA, 647 bp, Triticum aestivum
  CDS (57)..(551)
  misc_feature (32)..(32): n is a, g, c or t
  misc_feature (81)..(81): n is a, g, c or t
ccgcccgccttttcccccgcacagccgcaggnagagaaggcaaggaggaagggaagatgccggcggggcacgggctgcggncgcggacgcgcgacctggtcgcgcggcccttccgcaagaaggggtacatcccgctcaccacctacctgcgcacctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggtgcgtggtgaggtcatcagcaccaagaggcagccagcaggccccaagtctgggttcatggtggagggcaccaccatcgagacggacacccccatcccgtacgacgtcgtcaacgatctcaagggtggttactagagcgcttgttgtttccctgagccaagcttgaagccagttcctagcatctatgcttgttcccaatgcttctggtactgagaaggtccctttttgctc

SEQ ID NO: 15073 - protein, 164 aa, Triticum aestivum
  misc_feature (9)..(9): The Xaa at location 9 stands for Ala, Pro, Ser, or Thr.
MPAGHGLRXRTRDLVARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKVRGEVISTKRQPAGPKSGFMVEGTTIETDTPIPYDVVNDLKGGY

SEQ ID NO: 15074 - DNA, 741 bp, Gossypium hirsutum
  CDS (98)..(592)
cggaatcccccgcgtccgcccgcccgtccgcccacccctccctctctctctctcttctacaagccggcgagggaaggaaaacctgagagggtgaaaaatgccagctggtcacggtctccgatctcggaccagggatctgttttccagacccttcagaaagaagggttacatcccattgtccacttacctcaggacctacaagatcggtgactatgtggacgtcaaggtaaatggcgccgttcacaagggcatgccccacaagttctaccatggccgcactggtcgtgtctggaacgtcaccaagcgcgccatcggcgttgaggtcaacaagcaggtgggtaaccggattatcaggaagaggattcatgtcagagtggagcatgttcagccttcaaggtgcactgaggaattcaagctgaggaagatgaagaatgatcagctcaaggcagaggccaaggcaaagggtgaggtgattagcacaaagaggcagcctgagggcccaaaacctggtttcatggtcgagggtgcgatgttggaaacggttactcccattccatatgatgttgttaatgatctcaagggtggctactagatctactctgttttttggtttattcttggcataacttaagtaagctttgttagttattttggatgtgttgtttacgttttgtagtttattttgaagagttactgcttctgcaaagattttaatcttatcaatcattttattttagagat

SEQ ID NO: 15075 - protein, 164 aa, Gossypium hirsutum
MPAGHGLRSRTRDLFSRPFRKKGYIPLSTYLRTYKIGDYVDVKVNGAVHKGMPHKFYHGRTGRVWNVTKRAIGVEVNKQVGNRIIRKRIHVRVEHVQPSRCTEEFKLRKMKNDQLKAEAKAKGEVISTKRQPEGPKPGFMVEGAMLETVTPIPYDVVNDLKGGY

SEQ ID NO: 15076 - DNA, 684 bp, Zea mays
  CDS (45)..(539)
agttcggcggcttctatcagtttcacttgttcgcacgggaaaaaatgccggcaggacatggagttcgtgctagaacaagagatctgttcgcgagggggttcaggaagaagggtacaattccactgtccacctacctaaggaccttcaaggtcggcgaatacgtcgatgtcaaagtgaacggtgcgatacacaagggtatgcctcacaagttctaccacggtcgtactggtcgcgtctggaacgttaccaaacgtgccgttggtgtcgaagtcaacaaacagattggaaacaggatcataaagaagaggcttcatgtgcgtgtggagcacgtgcagcagtctagatgcgcggaagagttcaaactgaggataaggaagaacgatgagctcaaagctgctgctaaagcaagaggcgagacaataagcaccaagaggcagcctaaaggacccaaaccaggattcatggttgaaggtatgaccttggagacagtcactcctatcccctacgacgtcgtcaacgatctcaagggaggctattagttcttttctactttctctcctgttcttgctgtgtgttttggaactctgcatttgtagccacttgaactaaagaatatgatttatatgagaattttttggagtccagattttcattttgtgtggaatgttaaaaaaaaaaaaaaaa

SEQ ID NO: 15077 - protein, 164 aa, Zea mays
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIRKNDELKAAAKARGETISTKRQPKGPKPGFMVEGMTLETVTPIPYDVVNDLKGGY

SEQ ID NO: 15078 - DNA, 495 bp, Brassica napus
  CDS (1)..(495)
atgccggcgggtcacggagtgagggcgagaaccagggatctgttcgctagagggttcaggaagaagggtgttatcccactttccacctaccttaggaccttcaaagtcggtgattacgtggatgtgaaggtaaatggagccatccacaagggtatgcctcacaagttctaccatggtcgtactggtcgtgtctggaacgttactaagcgagctgttggtgtcgaagtcaacaagcagattggtaacagaatcattaggaagaggttgcatgttcgtgtggagcacgtgcagcagtcaaggtgtgctgaggagtttaaactaaggaagaagaataacgatgtgctcaaggctgcagccaaagccagaggggagacaatcagcaccaagagacagcctaaaggtcccaagcctggtttcatggtcgagggtatgacattggagactgtcactcccatcccttacgatgttgtcaacgatctcaagggtggctactaa

SEQ ID NO: 15079 - protein, 164 aa, Brassica napus
MPAGHGVRARTRDLFARGFRKKGVIPLSTYLRTFKVGDYVDVKVNGAIHKGMPHKFYHGRTGRVWNVTKRAVGVEVNKQIGNRIIRKRLHVRVEHVQQSRCAEEFKLRKKNNDVLKAAAKARGETISTKRQPKGPKPGFMVEGMTLETVTPIPYDVVNDLKGGY

SEQ ID NO: 15080 - DNA, 769 bp, Sorghum bicolor
  CDS (58)..(540)
  misc_feature (1)..(1): n is a, g, c or t
nctgcgatcaacttcagatttccgccctacgaacactccagcccacactcacacacaatgggtcacgcagccggtctccgcgcgggtacgcgctatgctttctcgagagacttcaagaagaagggtatgatccctctctcgacctacctcaagcagtacaaggtcggtgatatcgtcgatgtcgtagccaacggtgcggtccagaagggtatgccctacaaggtctaccacggcaagaccggtatcgtctacaacgtcaccaagtccgctgtcggtgtcatcctccagaagcaggtcggcaaccgatacatggagaagcgcatcaacgtccgcatcgagcacgtccgccactcccgctcacgagaggacttcctcaagcgcgtcaagctcaacttcgccaagcaacaaaaggccaaggagactggcgagccccagcagatgaagcgccagcccgcccagccccgcaccgagcacattgtcagcctcaaggagcaaaagccggagaacatcacacccatcccttacgagacctacatttagacgtggacagttggctcgggtgtattggctggcaaaatgggatacggatggtcaacggcgtggtttctcggacttctcgattattctctctttctgcactttcttacgcatggaaagcggcgataccatggtgcagatatagtggtgtgccaacatgggttttgagtgaccccctccgcccataaacatcatcttcccatcctaaaaaaaaaaaaaaattgcctctagg

SEQ ID NO: 15081 - protein, 160 aa, Sorghum bicolor
MGHAAGLRAGTRYAFSRDFKKKGMIPLSTYLKQYKVGDIVDVVANGAVQKGMPYKVYHGKTGIVYNVTKSAVGVILQKQVGNRYMEKRINVRIEHVRHSRSREDFLKRVKLNFAKQQKAKETGEPQQMKRQPAQPRTEHIVSLKEQKPENITPIPYETYI

SEQ ID NO: 15082 - DNA, 710 bp, Glycine max
  CDS (47)..(541)
ggcgattttaggtttttagtttcgcagtaacccaagaggagaaaaaatgccggcgggacatggagttcgtgctaggacaagagatctgttcgcgagggggttcaggaagaagggtacaattccattgtctacctacctcaggaccttcaaggtcggagattacgtggatgttaaagtgaatggtgcgatccacaagggtatgcctcacaagttctaccacggtcgtaccggtcgtgtctggaacgttaccaaacgtgctgttggtgtcgaagtcaacaaacagattggcaacaggatcataaagaagaggcttcatgtgcgtgtggagcacgtgcagcagtcgaggtgcgctgaggagttcaagctgaggattaagaagaacgatgagctcaaggctgcagccaaggccaaaggcgagacaataagcaccaagaggcagcctaaaggacccaaaccagggtttatggttgaaggtatgaccttggagactgtcaccccaatcccttacgacgtcgtcaacgatctcaagggaggctattagtttttctacttctactttctacccccagtgttttgctcagactttttggcagtttcttttgcgaattctcgagtgttcttcgtgcgttttcgctacagttacattttctttaaggttcaatccagacataatgaaacaaaagttgcaatctccaaaaaaaaaaaaaaaa

SEQ ID NO: 15083 - protein, 164 aa, Glycine max
MPAGHGVRARTRDLFARGFRKKGTIPLSTYLRTFKVGDYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 15084 - DNA, 715 bp, Zea mays
  CDS (51)..(545)
cttcggcgattttaaagttctgactggtcacatccaccaaagagacaaaaatgccggcaggacatggagttcgtgctcgaactagagatctgttcgctagagggttcaggaagaagggtacaattccactgtccacctacctaaggaccttcaaggtcggcgaatacgtcgatgttaaagtgaatggcgccatacacaagggtatgcctcataagttctaccatggtcgtactggtcgtgtctggaacgttaccaaacgtgccgttggtgtcgaagtcaacaaacagattggaaacaggatcataaagaagaggcttcatgtgcgtgtggagcatgtgcagcagtctagatgcgctgaggagttcaaactgaggataaagaagaacgatgagttgaaagctgcagccaaagccaaaggcgagacaataagcaccaagaggcagcctaaaggacccaaaccaggattcatggttgaaggtatgaccttggagaccgtcacccctatcccctacgacgttgtcaacgacctcaagggaggctattagttcttctctactttctttcctgttcttgctgtgtgttttggaactctgcatttgtagccacttgaactaagaatatgatttatatgagaattttgcaatccagtttgtttttatcatagttcaattttgtttgtcataaccattgattccaaccaaaaaaaaaaaaaaaa

SEQ ID NO: 15085 - protein, 164 aa, Zea mays
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 15086 - DNA, 699 bp, Panicum virgatum
  CDS (72)..(566)
ctcgctaaccctagcccccgcctcccacctgctccccgccgccgccgccgccgcaagtaggaccagccaggatgccggccggccacgggctgcgctcgcggacgcgcgacctcttcgcgcgtcccttccgcaagaaggggtacatcccgctcaccacctacctccgcaccttcaagatcggcgactacgtcgacgtcaaggtgaacggcgccgtccacaaggggatgccgcacaagttctaccacggccgcaccggtcgcgtgtggaacgtcactaagcgcgccatcggcgttgagatcaacaagcaggttaatggccgcatcatcaggaagcgtatccatgtccgtgtggagcatgtgcagcagtcccgctgcactgaggagttccgccagaggaaggcaaagaatgaccagctgaaagcagatgccaaggcacgcggtgaggtcatcagcaccaagaggcagccattgggtcccaagcctggcttcatggttgaaggtgctaccatcgagaccgtcacccccatcccatatgatgttgtcaacgatctcaagggcggttactaggttgctcggtctatctagccgcactaccagttctatatctgtattactctagtgggtacaattttgctctgtccgagcagtagtctggtcctattctgtgtgtttctgttgaaagattttccattctaggtgc

SEQ ID NO: 15087 - protein, 164 aa, Panicum virgatum
MPAGHGLRSRTRDLFARPFRKKGYIPLTTYLRTFKIGDYVDVKVNGAVHKGMPHKFYHGRTGRVWNVTKRAIGVEINKQVNGRIIRKRIHVRVEHVQQSRCTEEFRQRKAKNDQLKADAKARGEVISTKRQPLGPKPGFMVEGATIETVTPIPYDVVNDLKGGY

SEQ ID NO: 15088 - DNA, 495 bp, Populus balsamifera subsp. trichocarpa
  CDS (1)..(495)
atgccggctggtcacggtctccggtctcgcactagagatctcttcgctcgtccctttagaaagaagggttacattccattgacaacctacctcagaacctataagattggagaccatgtagacgttaaggttaacggcgccgtccacaagggtatgcctcacaagttttaccatggacgtactggcagagtctggaatgtcaccaaacgtgccatcggcgtagaggtcaacaagcaggtgggtaacaggatcatcaggaagaggatccatgtcagagtggaacatttgctaccctcaaggtgcactgaggaattccgtctcaggaagaagaagaatgatcaactaaaggcagaggctaaggccagaggtgaggttatctgcacaaagaggcagccagagggtcctaaacctggtttcatggtggaaggtgctacattggaaactgttactcccattccatatgatgttgttaacgatctcaagggaggttattag

SEQ ID NO: 15089 - protein, 164 aa, Populus balsamifera subsp. trichocarpa
MPAGHGLRSRTRDLFARPFRKKGYIPLTTYLRTYKIGDHVDVKVNGAVHKGMPHKFYHGRTGRVWNVTKRAIGVEVNKQVGNRIIRKRIHVRVEHLLPSRCTEEFRLRKKKNDQLKAEAKARGEVICTKRQPEGPKPGFMVEGATLETVTPIPYDVVNDLKGGY

SEQ ID NO: 15090 - DNA, 773 bp, Triticum aestivum
  CDS (84)..(578)
agcgccgcacacactccccccgcccgccgccgccgccgcacagccgcagggagagaaggcaaggaggaggaaggaaggggaagatgccggcggggcacgggctgcggtcgcggacgcgcgacctgttcgcgcggcccttccgtaagaaggggtacatcccgctcaccacctacctgcgcacctacaaggtcggggagcacgtcgacgtcaaggtgaacggcgccgtccacaagggcatgccgcacaagttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaagaggcagccagcagggcccaagcctgggttcatggtggagggcaccaccatcgagacggtcacccccatcccgtacgacgtcgtcaacgatctcaagggtggttactagagcgcttgtttcctgagcagaagcttgagccagttcttagtatctatgcttgttcccaatgttttggtactgagtagttctctttttgctccgccgagtgtgaacttctctgtggttaacattaaagatttcctgtggttgatttcgttcttgacatgctgctggatatatttgcttttaaaaaaaaaaaaaaaa

SEQ ID NO: 15091 - protein, 164 aa, Triticum aestivum
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLKGGY

SEQ ID NO: 15092 - DNA, 677 bp, Zea mays
  CDS (46)..(540)
ggcgatttttaggtttctacttgtcgcatccaccaaagaggaaaaatgccggcgggtcatggagttcgcgctaggacgagggatctgttcgcgagggggttcaggaagaagggtacaatcccactgtcgacttacctcaggaccttcaaggtcggcgattacgtggatgtcaaggtgaacggtgcgatccacaagggtatgcctcacaagttctaccacggtcgtaccggtcgtgtctggaacgtcaccaagcgagccgtcggtgtcgaagtcaacaaacagattggaaacaggatcattaggaagaggcttcatgtgcgtgtggagcacgtgcagcaatccaggtgtgcagaggagttcaagctgaggattaagaagaatgatgagctcaaggccgcagccaaagccagaggtgagacaataagcaccaagagacagcctaaaggccccaagccaggattcatggttgagggtatgaccttggagactgtcaccccaatcccctacgacgtcgtcaacgatctcaagggaggctattagttctactttcttccctcccagcgttttggagctttctttcatatggtttgtagcgacttaatactactggaagatgattttaaacagcatgagttttgttattgataccattgtgtctgccaaaaaaaaaaaaaaaa

SEQ ID NO: 15093 - protein, 164 aa, Zea mays
MPAGHGVRARTRDLFARGFRKKGTIPLSTYLRTFKVGDYVDVKVNGAIHKGMPHKFYHGRTGRVWNVTKRAVGVEVNKQIGNRIIRKRLHVRVEHVQQSRCAEEFKLRIKKNDELKAAAKARGETISTKRQPKGPKPGFMVEGMTLETVTPIPYDVVNDLKGGY

SEQ ID NO: 15094 - DNA, 495 bp, Glycine max
  CDS (1)..(495)
atgccggctggtcatggtttgagatcccgcaccagagattccttctctcgtcctttcaggaagaagggaaccatcgccctcaccacatacctgagaacctaccacgtcggcgactatgttgacgtcaaggttaacggtgccgttcacaagggaatgccccacaaattctaccatggccgcaccggacgcgtctggaatgtcaccaaacgtgctgttggcgtcgaagtcaacaagcaggttggcaacagaattataaggaagaggattcatgtgcgggtagagcatgttatgccttcaaggtgcactgaggagttccgcctcaggaagattaagaatgatcagctaaaggccgaagccaaggtcaagggtgagaagatcagcaccaagagacagcctcagggtcccaaacccggtttcatggtggagggtgcgacccttgagacagttacccccatcccatatgatgttgtcaatgacctcaagggaggttattag

SEQ ID NO: 15095 - protein, 164 aa, Glycine max
MPAGHGLRSRTRDSFSRPFRKKGTIALTTYLRTYHVGDYVDVKVNGAVHKGMPHKFYHGRTGRVWNVTKRAVGVEVNKQVGNRIIRKRIHVRVEHVMPSRCTEEFRLRKIKNDQLKAEAKVKGEKISTKRQPQGPKPGFMVEGATLETVTPIPYDVVNDLKGGY

SEQ ID NO: 15096 - DNA, 745 bp, Glycine max
  CDS (67)..(561)
aaaaaaaagagtgatccttctacactaactaaagccgagcagcgagagagagaaaccctagcaaaaatgccggctggtcacggtttgagatcccgcaccagagattccttctctcgtcccttcaggaagaagggtaccatcgccctcaccacatacctcagaacctaccacgtcggcgattatgtcgacgtcaaggttaacggcgccgtccacaagggaatgcctcacaagttctaccatggccgcaccggtcgcgtctggaatgtcaccaaacgtgctgttggggtcgaagtcaacaagcaggtcggcaacagaatcataaggaagaggattcacgtgcgtgtggagcatgttatgccatcaaggtgcactgaggagttccgccttaggaagatcaagaatgatcagctcaaggctgaggccaaggccaagggtgagaagatcagcaccaagagacagcctcagggtcccaaacctggtttcatggtcgagggggcaacgttggagacagttacccctattccctatgatgtcgtcaatgacctcaagggaggttattagtttcattctcgttgttggtctgcgtagttttttgtttggggattattagtccttttttgtgttggaagagaaacaattcagactattaaaatatttttgttgttttatttgatgttctaaatacatggatatgtttttgtttcgctcgtcataaatgtgctttttctcaaaaaaaaaaaaaaaa

SEQ ID NO: 15097 - protein, 164 aa, Glycine max
MPAGHGLRSRTRDSFSRPFRKKGTIALTTYLRTYHVGDYVDVKVNGAVHKGMPHKFYHGRTGRVWNVTKRAVGVEVNKQVGNRIIRKRIHVRVEHVMPSRCTEEFRLRKIKNDQLKAEAKAKGEKISTKRQPQGPKPGFMVEGATLETVTPIPYDVVNDLKGGY

SEQ ID NO: 15098 - DNA, 483 bp, Coprinopsis cinerea okayama7#130
  CDS (1)..(483)
atgcctcactcattcggttacagagcgcgtacgcgccacatgttcaagcggggcttcagagagaatggccctgccaaactcaccaccttcttgaccacctaccgagttggtgacattgtcgatatcaaggccaactctgcccagcaaaagggcatgccccacaaattctaccacggacgcactggtatcgtctacaacgtcaccccctcggctgtcggcatcatcgtttacaaggtcgtcggcaaccgctacgttgaaaagcgggtaaacatccgtatcgagcacgtcaagcactcgaaatgccgacaggagttcttggagcgagtgaaggccaaccacgatgctcacgttgctgcacgggagaagggcgagcgcatcaacctcaagcgatcccctgccctcccccgggaagcccatgtcatctccctcaaggacaacgctcctcaaacaatgacccccgtcccttacgagaccaccatctag

SEQ ID NO: 15099 - protein, 160 aa, Coprinopsis cinerea okayama7#130
MPHSFGYRARTRHMFKRGFRENGPAKLTTFLTTYRVGDIVDIKANSAQQKGMPHKFYHGRTGIVYNVTPSAVGIIVYKVVGNRYVEKRVNIRIEHVKHSKCRQEFLERVKANHDAHVAAREKGERINLKRSPALPREAHVISLKDNAPQTMTPVPYETTI

SEQ ID NO: 15100 - DNA, 486 bp, Culex pipiens quinquefasciatus
  CDS (1)..(486)
atgaccaactcgaagggttatcgccgcggaactcgggacatgttctcccgtcccttccgcaagcacggaaccatcccgctgtccacctacatgaaggtgtacaaggccggcgactatgtcgacattaagggtcacggtgccgtccacaagggcatgccctacaaggcgtaccacggcaagaccggccgcgtgtacaacgtcaccaagcacgccctcggcgtgatcgtgaacaagcgcgtccgcggcacgatcctggccaagcgcatcaacgtgcgcatcgagcacgtgaagccgtcccgctgccgtgaggacttcctgcgtcgcgtcaaggagaacgacaaggcgcgccacgagctgcgcaccaagaaccgcaaggccaagatctgcctgaagcgcaagccggcgcccccacgtggcgagcaggtcatcgtgaacccgcccacgccggtcttcctggccccgatcccgtacgagtttatcgcgtaa

SEQ ID NO: 15101 - protein, 161 aa, Culex pipiens quinquefasciatus
MTNSKGYRRGTRDMFSRPFRKHGTIPLSTYMKVYKAGDYVDIKGHGAVHKGMPYKAYHGKTGRVYNVTKHALGVIVNKRVRGTILAKRINVRIEHVKPSRCREDFLRRVKENDKARHELRTKNRKAKICLKRKPAPPRGEQVIVNPPTPVFLAPIPYEFIA

SEQ ID NO: 15102 - DNA, 480 bp, Bombyx mori
  CDS (1)..(480)
atgacgaactccaagggttaccgccgcggcaccagggacttgttcgctcgcaggttccgcacacatggaactattccgctctccacgtacatgaaagtgtacaaagttggagacattgtagacatcagaggcaatggtgcagttcaaaagggtatgccacacaaagtataccatggaaagacaggtcgcgtgtacaacgtgactgctcatgctctcggtgtgattgtcaacaagcgtgttcgcggaaggattataccgaagcgcatcaatatccgtgttgagcatgtcaagcactccaagtgcagacaagacttccttaagagagtcaaagagaatgagaggctactgaaggaagccaaggctgccggcaagaccgtcaacctgaagagacagccagctccccctaaagctgcccacatcgtcagtggaactgagaaacccgtcttacttgcgcctatcccatacgaattcgtagcgtaa

SEQ ID NO: 15103 - protein, 159 aa, Bombyx mori
MTNSKGYRRGTRDLFARRFRTHGTIPLSTYMKVYKVGDIVDIRGNGAVQKGMPHKVYHGKTGRVYNVTAHALGVIVNKRVRGRIIPKRINIRVEHVKHSKCRQDFLKRVKENERLLKEAKAAGKTVNLKRQPAPPKAAHIVSGTEKPVLLAPIPYEFVA

SEQ ID NO: 15104 - DNA, 480 bp, Drosophila melanogaster
  CDS (1)..(480)
atgaccaactcaaagggctatcgtcgcggcacacgggacatgttttcccgtcccttccgaaagcatggagttattccgttgtccacatacatgcgggttttcaagatcggcgacatcgttgacattaagggacatggtgctgtacagaagggtttgccctataaggcatatcatggcaaaaccgggcgcatattcaatgtgactcagcacgccgttggtgtaatagtaaacaaacgcgtaagaggcaaaatccttgctaagcgggtcaatgtgcgcattgagcacatccaccactccaagtgccgcgaagattttttgcgccgcgtaaaggaaaatgagcgattgctgaaggaggcgaaggaaaagggacaatgggtcagtctgaagcgccagccggaacagccgaagaaggcgcactttgttaagaaacttgaagaaccgattgctctggccccgattccatacgaattcattgcctaa

SEQ ID NO: 15105 - protein, 159 aa, Drosophila melanogaster
MTNSKGYRRGTRDMFSRPFRKHGVIPLSTYMRVFKIGDIVDIKGHGAVQKGLPYKAYHGKTGRIFNVTQHAVGVIVNKRVRGKILAKRVNVRIEHIHHSKCREDFLRRVKENERLLKEAKEKGQWVSLKRQPEQPKKAHFVKKLEEPIALAPIPYEFIA

SEQ ID NO: 15106 - DNA, 480 bp, Apis mellifera
  CDS (1)..(480)
atgacgaattcaaagggatatcgtcgaggaacaagggatttattttcccgaaaattccgtaaacatggaacaattccattatccacgtatatgaaagtatataaagtaggcgatatagttgatattaaaggtaacggagcagtgcaaaagggaatgccttataaagtttatcatggcaaaactggacgtgtatttaatgtaactccccatgctcttggtgtcattgttaataaaagagtacgtggacgaattattgcaaaaagaataaatgttcgtattgaacatttaactcattctaaatgtagagaagattttttgaaacgagtaaaagaaaatgaaagactcagaaaagaagcaaaggaaaaaaacattaaagtacaattgaaaagacaacctgctgaaccaatgcctgcacatattgtatcaggacgtgaaaatcctatttcacttgcacctataccctatgaatttattgcttaa

SEQ ID NO: 15107 - protein, 159 aa, Apis mellifera
MTNSKGYRRGTRDLFSRKFRKHGTIPLSTYMKVYKVGDIVDIKGNGAVQKGMPYKVYHGKTGRVFNVTPHALGVIVNKRVRGRIIAKRINVRIEHLTHSKCREDFLKRVKENERLRKEAKEKNIKVQLKRQPAEPMPAHIVSGRENPISLAPIPYEFIA

SEQ ID NO: 15108 - DNA, 489 bp, Strongylocentrotus purpuratus
  CDS (1)..(489)
atggtgaagacaaacaccacaggttaccgccgcggtacgcggtacatgttctctagggccttcaagaccaatggagtagaaaagctgtcaaccttcctgagggtgtacaagcgtggcgactatgtcgacatcaagggttgtggagccttccagaagggtatgccgtacaaggtataccatggacgtactggtcgtgtcttcaacgtcaccccccatgccgttggtgtggttgtgaacaagcaagtcagggatcgcgtcctgcccaagcgtatcaatgttcgcattgagcacatcaaggcatccaagagtcgagagggattcttggagaggaggagaaccaacgacatcctcaagaagcaagccaaggagaagggtgaattctaccagctcaagagacagcccacccagccaaggaaggctcactttgttagtgccaagaacaatgctccccaactgattgagcccatcccatacgagttcattgcatag

SEQ ID NO: 15109 - protein, 162 aa, Strongylocentrotus purpuratus
MVKTNTTGYRRGTRYMFSRAFKTNGVEKLSTFLRVYKRGDYVDIKGCGAFQKGMPYKVYHGRTGRVFNVTPHAVGVVVNKQVRDRVLPKRINVRIEHIKASKSREGFLERRRTNDILKKQAKEKGEFYQLKRQPTQPRKAHFVSAKNNAPQLIEPIPYEFIA

SEQ ID NO: 15110 - DNA, 546 bp, Nasonia vitripennis
  CDS (36)..(515)
tgcgtgtgcttcggcaaagaacgtagagtctcaaaatgacgaactccaagggttaccgcagaggtacgcgagacctgttctcgcgcaaattccgcaagagcggaactttgcccctgtctacgtacatgaaagtgtacaaggtcggcgacatcgttgacattaaaggtaatggagctgtccagaagggtatgccttacaaagtctaccatggaaagactggacgtgtcttcaatgtgacacagcatgctcttggagtcatcgtcaacaagagagtgcgtggacgcatcattgccaagcgcatcaatgtacgtatcgagcacttgaaccactccaagtgccgtgaggatttcatccagagagtcaagaagaacgaggctctgaggaaggaagccaaagagaagaaggtgaagatcagtctgaagagacagcctgcgcagcccagaccagcgcacattgtcaaaggaaaggaagcacctcaacttcttgcgccaattccttatgaatttatcgcttaattcgtaataaatttaattttttaaaattaca

SEQ ID NO: 15111 - protein, 159 aa, Nasonia vitripennis
MTNSKGYRRGTRDLFSRKFRKSGTLPLSTYMKVYKVGDIVDIKGNGAVQKGMPYKVYHGKTGRVFNVTQHALGVIVNKRVRGRIIAKRINVRIEHLNHSKCREDFIQRVKKNEALRKEAKEKKVKISLKRQPAQPRPAHIVKGKEAPQLLAPIPYEFIA

SEQ ID NO: 15112 - DNA, 486 bp, Aedes aegypti
  CDS (1)..(486)
atgaccaactcgaagggttatcgtcgtggtaccagggacatgttctcccgccccttcaggaagcacggaaccatccccctgtctacctacctgaaggtctacaaagccggagactacgtggacattaagggacacggtgccgtccacaagggtatgccctacaaggcatatcacggcaagactggccgcgtatacaacgtcaccaagcacgctctcggtgtcatcgtgaacaagcgtgtccgcggaaagatcctagccaagcgcatcaacgtccgcatcgagcatgtgaagccatcgcgctgccgtgaggatttcctgcgccgcgtcaaggaaaacgacgccgcccgccacgagctgaagacgaagaacccgaaggccaagatctgcttgaagcgcaagccacaagcacctcgcggcgagcaggtcatcgtgaacccaccggagcctgtcttcctggctccgatcccgtatgagttcgtagcataa

SEQ ID NO: 15113 - protein, 161 aa, Aedes aegypti
MTNSKGYRRGTRDMFSRPFRKHGTIPLSTYLKVYKAGDYVDIKGHGAVHKGMPYKAYHGKTGRVYNVTKHALGVIVNKRVRGKILAKRINVRIEHVKPSRCREDFLRRVKENDAARHELKTKNPKAKICLKRKPQAPRGEQVIVNPPEPVFLAPIPYEFVA

SEQ ID NO: 15114 - DNA, 492 bp, Chlamydomonas reinhardtii
  CDS (1)..(492)
atgcccggtggccaaggtctgcgcgcccgcacgcggcacatgtttgcccgcggcttccgccagaagggcttcatcccgctgacgacttacctgcgcacctacaagctcggggacatggtggacatcaaggtcaacggtgccatccacaagggcatgccccacaagtggtaccagggcaagaccggtaccgtctggaacgtcaccaagcgcgccatcggtgtggaggtcaacaagcgggttggccaccgcatcatgaagaagcgcatccacgtgcgtgtcgagcacatcgtgccctctcgctgccgtgaggagttcctgacccgccgcgcgtccaacgacgcggccaaggcggccgccaaggccaagggcgagcccgtccccaagaccaagcgtgtgcccgctggcccccgcgacggcttcgagctgatccccgccaaggtggagaccatcgccgccatcccctacgacatcatcaaggagggcctggtataa

SEQ ID NO: 15115 - protein, 163 aa, Chlamydomonas reinhardtii
MPGGQGLRARTRHMFARGFRQKGFIPLTTYLRTYKLGDMVDIKVNGAIHKGMPHKWYQGKTGTVWNVTKRAIGVEVNKRVGHRIMKKRIHVRVEHIVPSRCREEFLTRRASNDAAKAAAKAKGEPVPKTKRVPAGPRDGFELIPAKVETIAAIPYDIIKEGLV

SEQ ID NO: 15116 - DNA, 495 bp, Physcomitrella patens subsp. patens
  CDS (1)..(495)
atgccggctggtcatgggcttcgatctcgcactagagacttgttctctcgacctttcaggcacaaaggttacatccccttgacgacctacctgcgtaccttcaaggttggccagtatgtggacatcaaggtgaacggagccgtccacaagggtatgcctcacaagttctaccacgggcgcaccggcatcgtctggaacgtcaccaagcgtgccgtcggtgtcgtgatgaacaagcaggtcggaaacaggatcatccagaagcgtcttcatgtgcgtattgagcacgtgcagccttcacgctgccgggaagaatttcttgagcgtcgcaagagcaatgacgtcaagaaggctgaggccaaggctaggggcgaaacggtgaaccttaagcgtcagcctgctggtcctagggctggattcgttctcgattcctcaaccctagagactgtgactcccattccgtacgatgtcgtcaacgatctcaagggaggttattaa

SEQ ID NO: 15117 - protein, 164 aa, Physcomitrella patens subsp. patens
MPAGHGLRSRTRDLFSRPFRHKGYIPLTTYLRTFKVGQYVDIKVNGAVHKGMPHKFYHGRTGIVWNVTKRAVGVVMNKQVGNRIIQKRLHVRIEHVQPSRCREEFLERRKSNDVKKAEAKARGETVNLKRQPAGPRAGFVLDSSTLETVTPIPYDVVNDLKGGY

SEQ ID NO: 15118 - DNA, 495 bp, Physcomitrella patens subsp. patens
  CDS (1)..(495)
atgccggccggacacgggctgcgatcccgcaccagggacttgttctccaggcccttccgccacaaaggttacatccccttgactacctacttgcggaccttcaaggtcggccagtatgtggacatcaaggtgaacggagccgttcacaagggtatgccccacaagttctaccacggccgcactggaattgtctggaacgtcaccaagcgcgccgtcggcgttgtgatgaacaagcaggtcgggaacaggatcatccagaagcgtcttcatgtgcgcatcgagcacgttcagccttcacgctgccgggaagagttcctcgagcgccgtaagagcaatgacatcaagaaggctgaggccaaggctaagggtgaaactgtgaacctcaagcgtcagcctgctggtccaagggatggattcgttctggactcctctactctagagactgttactcccattccatacgatgtcgttaacgacctcaagggtggatactaa

SEQ ID NO: 15119 - protein, 164 aa, Physcomitrella patens subsp. patens
MPAGHGLRSRTRDLFSRPFRHKGYIPLTTYLRTFKVGQYVDIKVNGAVHKGMPHKFYHGRTGIVWNVTKRAVGVVMNKQVGNRIIQKRLHVRIEHVQPSRCREEFLERRKSNDIKKAEAKAKGETVNLKRQPAGPRDGFVLDSSTLETVTPIPYDVVNDLKGGY

SEQ ID NO: 15120 - DNA, 790 bp, Physcomitrella patens subsp. patens
  CDS (84)..(578)
ctttccccgcctcgttttctcttcttcctctcgctcgtcccagttgtgtgcagcagggtccgtcacactctgcagcggcaacaatgccggctggtcatgggttgcgatctcgcacgagggacctgttctccagacccttcaggcacaagggttacatccccttgaccacctacctgcgtaccttcaaggttggccagtatgtggatattaaggtgaacggtgctgtccacaagggtatgcctcacaagttctaccacggacgcaccggcatcgtctggaacgtcaccaagcgcgccgttggtgtcgtgatgaacaagcaggttggaaacaggatcatccagaagcgtctgcacgttcgaattgagcacgtgcagccctctcgttgcagggaagagtttctcgagcgccgcaagagcaatgacatcaagaaagctgaggctaaggctagaggcgagacagttgacctcaagcggcagcctgctggtcccagggctggattcgtccttgactcctccaccctagagaccgtgactcccattccttacgatgtcgtcaacgacctcaagggaggatactaagtcttgtctcttagctttactgtggtcgaacgtggttgtatctcaaccttttgaatacatggtttcgaccaagtttcactcctcaagcacgtctaaaagacaatgttatctggtttcaggatttcctggattttgtgcgtgcactgaaacgccaagtgattgttgcagtagctttgctttcacagatctaaatgtaataccgctgcattcat

SEQ ID NO: 15121 - protein, 164 aa, Physcomitrella patens subsp. patens
MPAGHGLRSRTRDLFSRPFRHKGYIPLTTYLRTFKVGQYVDIKVNGAVHKGMPHKFYHGRTGIVWNVTKRAVGVVMNKQVGNRIIQKRLHVRIEHVQPSRCREEFLERRKSNDIKKAEAKARGETVDLKRQPAGPRAGFVLDSSTLETVTPIPYDVVNDLKGGY

SEQ ID NO: 15122 - DNA, 495 bp, Physcomitrella patens subsp. patens
  CDS (1)..(495)
atgccggccggtcatggtctgcgatcccgcaccagagacctgttctccaggcccttcaggcacaaagggtacatccccttgaccacctacttgcgcaccttcaaggttggccaatatgtagacatcaaggtgaacggagccgtccacaagggaatgccccacaagttctaccacgggcgcaccggtatcgtctggaatgtcaccaagcgcgcagttggtgtcgtgatgaacaagcaggtcgggaacaggatcatccagaagcgtcttcatgtgcgcattgagcacgtgcagccttcacgctgccgggaagagttcctcgagcggcgcaagagcaatgaccttaagaaggccgaggcgaaggccaagggtgaaaccgtgaacctcaagcgtcagcctgctgggcctagggccggatttgttctcgactcgtcaactctagagactgtcactcccattccttacgatgttgttaacgacctcaagggaggatactaa

SEQ ID NO: 15123 - protein, 164 aa, Physcomitrella patens subsp. patens
MPAGHGLRSRTRDLFSRPFRHKGYIPLTTYLRTFKVGQYVDIKVNGAVHKGMPHKFYHGRTGIVWNVTKRAVGVVMNKQVGNRIIQKRLHVRIEHVQPSRCREEFLERRKSNDLKKAEAKAKGETVNLKRQPAGPRAGFVLDSSTLETVTPIPYDVVNDLKGGY

SEQ ID NO: 15124 - DNA, 489 bp, Anopheles gambiae str. PEST
  CDS (1)..(489)
atgacgaactcgaagggttatcgccgtggtactcgggacatgttctcccgtggcttccgcaagcatggaaccatcccgctgtccacctacatgaagatctacaagtccggcgactatgttgacatcaagggacacggtgccgtgcacaagggtatgccctacaaggcgtaccacggcaagactggccgtgtgtacaacgtctcgaagcacgcgctcggcgtgatcgtgaacaagcgcgtccgcggcaagatcctacccaagcgcatcaacgtccgcgtcgagcatgtgcagccgtcccgctgccgcgaggacttcctgcgccgcgtcaaggagaacgtggagaagcgcatggcgctgcggggcaagaagctgcccggcttcaaggtgtcgctgaagcgcaagccgaaacagccgcgccaggctcaggtcatcaagaacccgccgaagcccatcttcctcgccccgatcccgtacgaattcgtggcctaa

SEQ ID NO: 15125 - protein, 162 aa, Anopheles gambiae str. PEST
MTNSKGYRRGTRDMFSRGFRKHGTIPLSTYMKIYKSGDYVDIKGHGAVHKGMPYKAYHGKTGRVYNVSKHALGVIVNKRVRGKILPKRINVRVEHVQPSRCREDFLRRVKENVEKRMALRGKKLPGFKVSLKRKPKQPRQAQVIKNPPKPIFLAPIPYEFVA

SEQ ID NO: 15126 - DNA, 483 bp, Gibberella zeae PH-1
  CDS (1)..(483)
atgggtcactcatacggaaagagagcgggcacccgctatgccttcagccgggacttccgcaagaagggtatgattgccctgaacacctacctccgacagtaccgcgttggagatatcgtcgacattaaggcgaacggtgccgtccagaagggtatgcccttcaaggtctaccacggaaagactggtgtcatctacaacgtcaccaagtccgctgtcggtgtcatcatctacaagcaggtcaagcaccgatacatcgagaagcgaatcaacgtccgaatcgagcacatctcgcagtcccgatctcgtgaggacttcctcaagcgagtcaaggctaacgccgaggccaagcgtgaggccaaggccaccggaaccgttgtccaggtcaagcgtcagccccttggacctcgtggcgcccacacactgtcgctctccgagaacccccccatgaccgttacccctcttgcctacgagaccacgatctaa

SEQ ID NO: 15127 - protein, 160 aa, Gibberella zeae PH-1
MGHSYGKRAGTRYAFSRDFRKKGMIALNTYLRQYRVGDIVDIKANGAVQKGMPFKVYHGKTGVIYNVTKSAVGVIIYKQVKHRYIEKRINVRIEHISQSRSREDFLKRVKANAEAKREAKATGTVVQVKRQPLGPRGAHTLSLSENPPMTVTPLAYETTI

SEQ ID NO: 15128 - DNA, 483 bp, Candida glabrata CBS 138
  CDS (1)..(483)
atgggtaaatctcacggttacagatctcgtactcgttacatgttccaacgtgacttccgtaagcacggtgctattgcattgtccacttacttgaaggtctacaaggttggtgacattgtcgatatcaaggctaacggttccatccaaaagggtatgccacacaagttctaccaaggtaagaccggtgttgtctacaacgtcaccaagtcttccgttggtgtcatcgttaacaagatggttggtaacagatacttggaaaagagattgaacttgagagtcgaacacgtcaagcactccaagtgtagacaagaatttttggacagagttaagtctaacgctgccaagagagctgaagccaaggcccaaggtaaggctgtccaattgaagagacaaccagctcaaccaagagaagcccgtgtcgtctccactgaaggtaacgttcctcaaactttggccccagtcgcttacgaaaccttcatctaa

SEQ ID NO: 15129 - protein, 160 aa, Candida glabrata CBS 138
MGKSHGYRSRTRYMFQRDFRKHGAIALSTYLKVYKVGDIVDIKANGSIQKGMPHKFYQGKTGVVYNVTKSSVGVIVNKMVGNRYLEKRLNLRVEHVKHSKCRQEFLDRVKSNAAKRAEAKAQGKAVQLKRQPAQPREARVVSTEGNVPQTLAPVAYETFI

SEQ ID NO: 15130 - DNA, 483 bp, Kluyveromyces lactis NRRL Y-1140
  CDS (1)..(483)
atgggtaaatcacacggttacagatctcgtactcgttacatgttccaacgtgactttagaaagcacggtgccatcgccttgtctacctacatgaaggtttacaaggttggtgacattgttgacatcaaggctaacggttctatccacaagggtatgccacacaagttctaccaaggtaagaccggtgttgtctacaacgtcaccaagtcttccgttggtatcatcatcaacaagatggttggtaacagatacttggaaaagagattgaacttgagagttgaacacatcaagcactccaagtgtagacaagaatttttggaaagagttaagtctaacgctgccaagaaggccgaagctaaggctcaaggtgttgccgtccaattaaagagacaaccagctcaaccaaaggaatcccgtgtcgtttctaccgaaggtaacgtccctcaaactttggctccagttccatacgaaactttcatctaa

SEQ ID NO: 15131 - protein, 160 aa, Kluyveromyces lactis NRRL Y-1140
MGKSHGYRSRTRYMFQRDFRKHGAIALSTYMKVYKVGDIVDIKANGSIHKGMPHKFYQGKTGVVYNVTKSSVGIIINKMVGNRYLEKRLNLRVEHIKHSKCRQEFLERVKSNAAKKAEAKAQGVAVQLKRQPAQPKESRVVSTEGNVPQTLAPVPYETFI

SEQ ID NO: 15132 - DNA, 483 bp, Debaryomyces hansenii CBS767
  CDS (1)..(483)
atgggtaaatctcgtggttatagatccggtactcgttacctttttcaacgtgactttaagaagcatggtgctattccattatctacttacttgaagacttacagagttggtgatatcgttgatatcaaggccaatggttctatccaaaagggtatgccacataagtactaccaaggtaagactggtatcgtttacaacgtcaccaagtctgctgttggtgttattatctacaaagttgttggtaacagatacctcgaaaagagaattaacttgagagtcgaacacattaagcactccgcttgtcgtcaagaattcatcaacagagttaaatctaacgctgctttaaagagagaagccaaggccaacggtgaacacgttcacttgaagagacaacctgttaagccaagagacgctagagttgttactaccaaggaaaacgttccacaaaccttagctccagttccttatgaaaccttcatttaa

SEQ ID NO: 15133 - protein, 160 aa, Debaryomyces hansenii CBS767
MGKSRGYRSGTRYLFQRDFKKHGAIPLSTYLKTYRVGDIVDIKANGSIQKGMPHKYYQGKTGIVYNVTKSAVGVIIYKVVGNRYLEKRINLRVEHIKHSACRQEFINRVKSNAALKREAKANGEHVHLKRQPVKPRDARVVTTKENVPQTLAPVPYETFI

SEQ ID NO: 15134 - DNA, 486 bp, Yarrowia lipolytica CLIB122
  CDS (1)..(486)
atgggtaagagtcacggatacagaagcagaacccgatacatgttctctcgggacttcaagaagaacggaactatccccatgtccgtctacttgaagacctacaaggttggagacattgttgacatccgagccaacggttccatccagaagggtatgccccacaagttctaccacggccgaactggaatcgtctacaacgtgaccaagtccgctgttggcgtcatcatcaacaaggttgttggcaaccgattcatggagaagcgaatcaacctccgaatcgagcacatcaagcactccaagtgccgacaggagttccttgaccgagtcaaggccaacgatctcaagcgaaaggaggccaaggccaagaacgagattgtccagctccgacgacagcccggcgccacccgagaggccaagacccttgccatcgacgagaccaactaccctctcaccgttgctcctcttgcttacgagactttcatctaa

SEQ ID NO: 15135 - protein, 161 aa, Yarrowia lipolytica CLIB122
MGKSHGYRSRTRYMFSRDFKKNGTIPMSVYLKTYKVGDIVDIRANGSIQKGMPHKFYHGRTGIVYNVTKSAVGVIINKVVGNRFMEKRINLRIEHIKHSKCRQEFLDRVKANDLKRKEAKAKNEIVQLRRQPGATREAKTLAIDETNYPLTVAPLAYETFI

SEQ ID NO: 15136 - DNA, 477 bp, Aspergillus nidulans FGSC A4
  CDS (1)..(477)
atgggtcactcccacggtctccgttccggcacccggtatgccttctcccgcaacttccgtgagaagggtcagatccgcctctcgacctacctgaagacctaccgggttggtgacattgtggacatcaaggtcaacggtgccgttcagaagggtatgccctacaaggtctacaacggtaagaccggtgtcgtttacaacgtcaccaagtcctccgtcggtgtcctcctctacaaggtcgtcggcaaccgctacctcgagaagcgtatcaacgtccgcatcgagcacgtcaagcactctcgctcccgtgaggatttcatcaagcgtgtcaaggagaacgccgagaagaagaagcaggccaaggagcagggcatccaccttcacctcaagcgccagcccgcccagcctcgtgaggctcacaccgtcgagggctccactcccgaaaccatcactcctctgccttacgacacccacatctaa

SEQ ID NO: 15137 - protein, 158 aa, Aspergillus nidulans FGSC A4
MGHSHGLRSGTRYAFSRNFREKGQIRLSTYLKTYRVGDIVDIKVNGAVQKGMPYKVYNGKTGVVYNVTKSSVGVLLYKVVGNRYLEKRINVRIEHVKHSRSREDFIKRVKENAEKKKQAKEQGIHLHLKRQPAQPREAHTVEGSTPETITPLPYDTHI

SEQ ID NO: 15138 - DNA, 516 bp, Ustilago maydis 521
  CDS (1)..(516)
atggaaaggtctttagtcgacacagtagcgttgacattcttcatcagcgcgtatgtggcccgcacccgtcacctcttcgcgaggaagttccgtcagcatggtcccatcaagctgtcgacctacctccgacccttccacgccggtgacattgtcgacatcaaggccaacgctgccgagcaaaagggtatgccccacaagtactaccacggccgtactggtgtagtcttcaacgtcgccccacgagctgttggtgtgatcatctacaaggtggtcggaaaccgatacatcgagaagcgtgtcaacgtccgcattgagcacgtcaagcactccaagtgccgagacgatttcctgcagcgtgtcaagcgcaacgctgagctcaagaaggaggccaaggccaagggtgagcacgtgcagcttaagcgtctgcccgctgccccccgcactgcccacaccatctcgatgaagaacaacacccccgagacccttgctccccaggcttacgacacctacatctaa

SEQ ID NO: 15139 - protein, 171 aa, Ustilago maydis 521
MERSLVDTVALTFFISAYVARTRHLFARKFRQHGPIKLSTYLRPFHAGDIVDIKANAAEQKGMPHKYYHGRTGVVFNVAPRAVGVIIYKVVGNRYIEKRVNVRIEHVKHSKCRDDFLQRVKRNAELKKEAKAKGEHVQLKRLPAAPRTAHTISMKNNTPETLAPQAYDTYI

SEQ ID NO: 15140 - DNA, 483 bp, Cryptococcus neoformans var. neoformans B-3501A
  CDS (1)..(483)
atgcctcactctttcggtatgcgagcgcgaacgcgccacatgttcaggaggggtttcaaggagcacggtgcccccagcgtctccaccttcctcatcacctaccgagttggtgacatcgttgacatcaaagccaactcttctcagcagaagggtatgccccacaagttctaccacggcaagaccggtatcgtctacaacgttaccccccgagctgtcggtgtgatcatctacaaggtcgtcaacggccgatacatggagaagcgtgtcaacatccgagttgagcacatccgtcactccaagtgccgacaggaattccttgaccgtgtcaagtccaacgccgccaagaagaaggaggccaaggaaaagggcgagcaagtcctccttaagcgactccctgctcagccccgagaggccagggttgtttccatccacaacaacgtcccccagacccttaccgccaggccttacgagaccttcatctaa

SEQ ID NO: 15141 - protein, 160 aa, Cryptococcus neoformans var. neoformans B-3501A
MPHSFGMRARTRHMFRRGFKEHGAPSVSTFLITYRVGDIVDIKANSSQQKGMPHKFYHGKTGIVYNVTPRAVGVIIYKVVNGRYMEKRVNIRVEHIRHSKCRQEFLDRVKSNAAKKKEAKEKGEQVLLKRLPAQPREARVVSIHNNVPQTLTARPYETFI

SEQ ID NO: 15142 - DNA, 480 bp, Tribolium castaneum
  CDS (1)..(480)
atgacgaactcgaaaggttatcgtaggggaacccgggacctgttctctcggaagttccgcaagcatggggttatccccctgtcgacgtacatgaaagtgtacaaagtcggcgatatcgtggatattaagggcaatggagccgttcagaagggcatgccctacaaggtgtaccatgggaaaactggccgtgtgttcaatgtgacggctcacgctttgggtgtgattgttaacaagcgtgttgggggccgtattatccccaaacgtatcaatatccgtattgagcacgtgaatcactccaagtgcaggcaagacttcttgaccagagtgaaacaaaacgaaaaattgcgaaaagaagctaaggagaagaacattcgagtgaatttgaagagacagccagcacagccaaggcctgcacacatcgtcagtgggaaagtaccagccgttcaattggctcctatcccatatgaatttattgcttaa

SEQ ID NO: 15143 - protein, 159 aa, Tribolium castaneum
MTNSKGYRRGTRDLFSRKFRKHGVIPLSTYMKVYKVGDIVDIKGNGAVQKGMPYKVYHGKTGRVFNVTAHALGVIVNKRVGGRIIPKRINIRIEHVNHSKCRQDFLTRVKQNEKLRKEAKEKNIRVNLKRQPAQPRPAHIVSGKVPAVQLAPIPYEFIA

SEQ ID NO: 15144 - DNA, 477 bp, Maconellicoccus hirsutus
  CDS (1)..(477)
atgacgaactctaaaggataccgacgcggaaccagggacttgttcgcccgcaaattcaggcaacatggtactatcccgttatcgaagtacctcgaagtatacaaagtcggagattacgttgacatcaaaggtaatggtgccgttcagaaaggtatgccatacaaagcttaccacggtagaaccggcagagtgttcaacgttacgaaacacgctttgggtgttattgtaaataaacgtgtaagaaatcgtatcatccctaaaagaattaatgtaagaattgaacacgtatcgcattcgaaatgcagagatgattttcttaagcgcgtaagaaataatggtaaaagattgaaagtcgctaagaaagccggaattaccattagtttgaaaagaaaacctgaagaacctaaaccaggtcatgttgtaaaaggacaagaacccattgtgttggctcctctgccatacgaatttattgcataa

SEQ ID NO: 15145 - protein, 158 aa, Maconellicoccus hirsutus
MTNSKGYRRGTRDLFARKFRQHGTIPLSKYLEVYKVGDYVDIKGNGAVQKGMPYKAYHGRTGRVFNVTKHALGVIVNKRVRNRIIPKRINVRIEHVSHSKCRDDFLKRVRNNGKRLKVAKKAGITISLKRKPEEPKPGHVVKGQEPIVLAPLPYEFIA

SEQ ID NO: 15146 - DNA, 495 bp, Vitis vinifera
  CDS (1)..(495)
atgccggcaggtcacgggcttagaagtaggacgagggatctgtttgctcgtccattcaggaagaagggttacatccctctcacagtttatctcagaacctacaagattggggattacgtggatatcaaggtgaacggcgccattcacaagggcatgccccacaagttctatcatggccgcaccggcaaggtctggaacgtcaccaagcgtgccataggcgttgaagtcaacaaacaggttgggaataggattattaggaaaaggatccatgtgcgggtggaacatgttcaaccatcaaggtgcagggaagaatttaaactgaggaaaattcggaacgatgagtcgaaagccgaggcaaaaaagcgtggggagaagatcagcacaaaaagacagccagaaggacccaagcctggtttcatggtggagggtgccaccctagaaacagttacaccaatcccatatgatgtggtgaatgacctcaagggcggatactga

SEQ ID NO: 15147 - protein, 164 aa, Vitis vinifera
MPAGHGLRSRTRDLFARPFRKKGYIPLTVYLRTYKIGDYVDIKVNGAIHKGMPHKFYHGRTGKVWNVTKRAIGVEVNKQVGNRIIRKRIHVRVEHVQPSRCREEFKLRKIRNDESKAEAKKRGEKISTKRQPEGPKPGFMVEGATLETVTPIPYDVVNDLKGGY

SEQ ID NO: 15148 - DNA, 495 bp, Vitis vinifera
  CDS (1)..(495)
  misc_feature (204)..(204): y is t or c
  misc_feature (411)..(411): r is g or a
atgccggccggacatggacttcgatcgaggactcgagatctcttcgccaggcccttcaggaagaagggttacattcctttgaccacatatctgagaaccttccgcatcggagagtacgtggacatcaaggtaaacggcgccatccacaagggcatgccccacaagttctaccatggccgcactggtaaggtctggaacgttacyaagcgcgccatcggcgtcgaagtaaacaagcaggtgggtaacaggattatcaagaagcggatccatgtgcgtgtggagcatgtgcaaccttcaaggtgcactgaggaattccgtctgaggaagttgaagaatgatgaattgaagacagctgcaaagaagaacggtgaaatcatcagcacaaagaggcagccagagggccctaagccrggtttcatggtggaaggtgcaactttggaaactgttactccgatcccctacgatgttgtcaacgatctcaagggtggttattag

SEQ ID NO: 15149 - protein, 164 aa, Vitis vinifera
MPAGHGLRSRTRDLFARPFRKKGYIPLTTYLRTFRIGEYVDIKVNGAIHKGMPHKFYHGRTGKVWNVTKRAIGVEVNKQVGNRIIKKRIHVRVEHVQPSRCTEEFRLRKLKNDELKTAAKKNGEIISTKRQPEGPKPGFMVEGATLETVTPIPYDVVNDLKGGY

SEQ ID NO: 15150 - DNA, 498 bp, Vitis vinifera
  CDS (1)..(498)
atgccggcgggacacggactccgatcgaggactcgagacttgttcgccaggcccttcaggaagaagggttacattcccttgacaacgtacctgagaacctttcgcatcggagactacgtggacatcaaagtaaacggcgccgtccacaagggcatgccccacaagttctaccatggccgcactggtaaggtctggaacgtcaccaagcgcgccatcggtgttgaagtaaacaagcaggtgggtaacaggataatcaagaagcggatccatgtgcgagtggagcatgtgcaaccttcaaggtgtactgaggaattccggctgaggaagttgaagaatgatgaattgaaggcagaggcaaaaaagaacggaggtcagatcatcagcacgaaaaggcagccagaggggcctaaaccaggtttcatggtggaaggtgcaaccttggaaactgttactccaattccttatgatgttgtcaatgatctcaagggtggctactag

SEQ ID NO: 15151 - protein, 165 aa, Vitis vinifera
MPAGHGLRSRTRDLFARPFRKKGYIPLTTYLRTFRIGDYVDIKVNGAVHKGMPHKFYHGRTGKVWNVTKRAIGVEVNKQVGNRIIKKRIHVRVEHVQPSRCTEEFRLRKLKNDELKAEAKKNGGQIISTKRQPEGPKPGFMVEGATLETVTPIPYDVVNDLKGGY

SEQ ID NO: 15152 - DNA, 465 bp, Vitis vinifera
  CDS (1)..(465)
atgccggcaggtcacgggcttagaagtaggacgagggatctgtttgctcgtccattcaggaagaagggttacatccctctcacagtttatctcagaacctacaagattggggattacgtggatatcaaggtgaacggcgccattcacaagggcatgccccacaagttctatcatggccgcaccggcaaggtctggaacgtcaccaagcgtgccataggctttttattgaaaaggatccatgtgcgggtggaacatgttcaaccatcaaggtgcagggaagaatttaaactgaggaaaattcggaacgatgagtcgaaagccgaggcaaaaaagcgtggggagaagatcagcacaaaaagacagccagaaggacccaagcctggtttcatggtggagggtgccaccctagaaacagttacaccaatcccatatgatgtggtgaatgacctcaagggcggatactga

SEQ ID NO: 15153 - protein, 154 aa, Vitis vinifera
MPAGHGLRSRTRDLFARPFRKKGYIPLTVYLRTYKIGDYVDIKVNGAIHKGMPHKFYHGRTGKVWNVTKRAIGFLLKRIHVRVEHVQPSRCREEFKLRKIRNDESKAEAKKRGEKISTKRQPEGPKPGFMVEGATLETVTPIPYDVVNDLKGGY

SEQ ID NO: 15154 - DNA, 486 bp, Spadella cephaloptera
  CDS (1)..(486)
atgacgaattccaaaggataccgaagaggcacgcgttacatgttcaggcgcccattccgcaagaatggtgtgccctccgtcgccaccttgttgaaggtctacaagatcggcgacatcgtcgacatcaagggcgacggatccgtgcatagtgggatgccccataagtactaccacggccgtacgggtcgcgtcttcaacgtgacgacgaggtcattgggtgtggtcgtgacgaagccagtccgaaatcgcatcgaaaagaagaagatttgcatccgcgcggaacacgtgcgccattcgagctgtcgccaggatttcttagaccgcgtgaaacgtaacgacacgattcgtcgtgagtgcaagaaaaacgggacggaagttccagacctgaagcggaagcccgtcgggccacgacccgcccacattgttcgcacaaagaacaacaagccctccttgttccagcccatcccttacgaatttatcgtttaa

SEQ ID NO: 15155 - protein, 161 aa, Spadella cephaloptera
MTNSKGYRRGTRYMFRRPFRKNGVPSVATLLKVYKIGDIVDIKGDGSVHSGMPHKYYHGRTGRVFNVTTRSLGVVVTKPVRNRIEKKKICIRAEHVRHSSCRQDFLDRVKRNDTIRRECKKNGTEVPDLKRKPVGPRPAHIVRTKNNKPSLFQPIPYEFIV

SEQ ID NO: 15156 - DNA, 474 bp, Sipunculus nudus
  CDS (1)..(474)
atgacgagcaccaagggatacaggcggggtacccgctacatgttcgccagacaattcacaaaacgtggcatcatcccattgtccacttacatgatcacataccgccgtggtgacatcgtggatatcaagggatgcggagcaattcacaaaggtatgccccacaaggcttaccatggcgagacaggacgggtgtacaatgtcacacagcatgctgttggtgtcattgtaaacaaacgtgtcaaaggcaaaatccttgccaagagacttaacatcagagttgaacacatcaagcactccaactgtcgtctggacttcttgcgtcgtgtcaaagctaacgaggagaagaggaaggatacaacagacaaggtttccctccagcgtattcctcgtcaaccccgcggaggacactttgtgaggaccaagaacaacaagccagagttcctagagcccatcccatacgtcttcacagcttaa

SEQ ID NO: 15157 - protein, 157 aa, Sipunculus nudus
MTSTKGYRRGTRYMFARQFTKRGIIPLSTYMITYRRGDIVDIKGCGAIHKGMPHKAYHGETGRVYNVTQHAVGVIVNKRVKGKILAKRLNIRVEHIKHSNCRLDFLRRVKANEEKRKDTTDKVSLQRIPRQPRGGHFVRTKNNKPEFLEPIPYVFTA

SEQ ID NO: 15158 - DNA, 483 bp, Arenicola marina
  CDS (1)..(483)
atgacgaacactaagggtttgcgccgggggacccgggatatgttttcccggtccttcaggaaacatggcaccatgtgcctgtccacatacatgaagctgtacaagaggggtgatattgttgatatcaagggtgatggtgctatccagaaaggtatgccacacaagatctaccatggcaagactggacgcatttataatatcacaccacatgctgtaggtgttgttgtcaacaagcgagtcagggggcgcatcattgccaagcgcatcaacgtgcgcattgagcacatcaagcactccaagtgccgacaggaattcttgatccgtgttgaggagaaccagaggaagaagaaggaggccactgcgaagggagagcaggtcctctgcaagagggagcccaagcagccccgtcaacgccacttcgtcagcaccaagttcatgaaaccggaaattctgcagcccatcccctacgagtttatcgcctaa

SEQ ID NO: 15159 - protein, 160 aa, Arenicola marina
MTNTKGLRRGTRDMFSRSFRKHGTMCLSTYMKLYKRGDIVDIKGDGAIQKGMPHKIYHGKTGRIYNITPHAVGVVVNKRVRGRIIAKRINVRIEHIKHSKCRQEFLIRVEENQRKKKEATAKGEQVLCKREPKQPRQRHFVSTKFMKPEILQPIPYEFIA

SEQ ID NO: 15160 - DNA, 483 bp, Eurythoe complanata
  CDS (1)..(483)
atgacgaacacgaaaggttaccgccgtggcacccgctacatgttctcccggaaattccggacaaaaggtgtcataccactggggacatatatgaaagtgtacaaacgtggtgatattgtagacatcaagggcaatggagcggtacaaaaaggtatgccacacaagtcataccacggcagaacaggcagaatttacaatgtgacacctcatgctgtgggtgtcattgtaaacaagagagtcaagggacgcatcttggccaagaggatcaatgttcgcattgagcatgtgaagcactccaactgcagactggactttatcaacagggtccatgagaatgagaagaagaagcgagctgcaaaggcaaagggtgaccgggtggaatgcaaaagacagcctttacaacccagagccggacactttgtcagcactaagtacaacaagccagagtatttgcagcctattccatatgaatttatcgcttaa

SEQ ID NO: 15161 - protein, 160 aa, Eurythoe complanata
MTNTKGYRRGTRYMFSRKFRTKGVIPLGTYMKVYKRGDIVDIKGNGAVQKGMPHKSYHGRTGRIYNVTPHAVGVIVNKRVKGRILAKRINVRIEHVKHSNCRLDFINRVHENEKKKRAAKAKGDRVECKRQPLQPRAGHFVSTKYNKPEYLQPIPYEFIA

SEQ ID NO: 15162 - DNA, 498 bp, Picea sitchensis
  CDS (1)..(498)
atgccggcaggccatggagtgcgcgctcggacgagggatctgttcgccaggcccttcaggaagaagggatacgctccaatcagcacatatctgaggacctttaaaataggtcagtacgtggacattaaggtcaatggttcgattcacaaagggatgcctcacaagttctaccatggccgcacaggcgttgtctggaacgtcaccaagcgagccatcggcgtcgaaatgaacaaacaggttcgtaacaagattatcaagaagagaattcatgtacgaattgagcatgtgcaaccgtctaggtgtgcacaggatgccttgttaagaaggaaaaacaacgaccagttgaaggcagaggctaaagcacgtggcgagcctcctatcagcaccaagaggcagcctgagggccctaagccaggatttatggtcgagggtgctgttttggagacagtcacacctattccatatgatgttgttaatgatttgaagggtggatattaa

SEQ ID NO: 15163 - protein, 165 aa, Picea sitchensis
MPAGHGVRARTRDLFARPFRKKGYAPISTYLRTFKIGQYVDIKVNGSIHKGMPHKFYHGRTGVVWNVTKRAIGVEMNKQVRNKIIKKRIHVRIEHVQPSRCAQDALLRRKNNDQLKAEAKARGEPPISTKRQPEGPKPGFMVEGAVLETVTPIPYDVVNDLKGGY

SEQ ID NO: 15164 - DNA, 498 bp, Picea sitchensis
  CDS (1)..(498)
atgccggcaggccatggagtgcgcgcacggacgagggacttgttcgccaggcccttcaggaagaagggatacgcccctctcagcacatatctgaggagctacaagatagggcagtacgttgatattaaggtcaatggttcgattcacaagggtatgcctcacaagttctaccatggtcgcaccggtgttgtctggaatgtcaccaagcgagcaatcggcgtcgaaatgaacaaacaggttcgtaacaagattatcaagaagagaattcatgtacgaattgagcatgtgcaaccgtctaggtgtgcagaggatgccatattaagaagaaaaaataacgatcaattaaaggcagaagctaaagcacgtggtgagccacgtatcagcaccaaaaggcagcccgagggccctaagccaggatttatggttgagggtgctgttttggagacagtcacacctattccatatgatgttgttaatgatttgaagggtggatattaa

SEQ ID NO: 15165 - protein, 165 aa, Picea sitchensis
MPAGHGVRARTRDLFARPFRKKGYAPLSTYLRSYKIGQYVDIKVNGSIHKGMPHKFYHGRTGVVWNVTKRAIGVEMNKQVRNKIIKKRIHVRIEHVQPSRCAEDAILRRKNNDQLKAEAKARGEPRISTKRQPEGPKPGFMVEGAVLETVTPIPYDVVNDLKGGY

SEQ ID NO: 15166 - DNA, 495 bp, Populus trichocarpa
  CDS (1)..(495)
atgccagctggacatggtttgcgatcaaggaccagagatctcttcgctcgtcccttcaggaagaagggttacatccctctcaccacatacctcagaacgtacaaggtaggcgactatgtcgacattaaggtaaatggcgctgtccacaaaggcatgccccacaagttctaccatggccgcaccggtcgcgtctggaatgtaaccaagcgcgctattggtgtcgtcatcaacaagcaggttgggaataggattattgggaagagaattcatgttagggtggagcatgtgcagccgtcgaggtgcagggaggagttcaagttgaggaagaagaagaatgatgagttgaaggcggaggccaaagctcgtggtgaaaagattagtactaagagacagcctcaaggaccgaagcccggatttatggtggagggtgctactcttgagactttcactcccattccttatgatgtggtcaatgatctcaagggtggttattga

SEQ ID NO: 15167 - protein, 164 aa, Populus trichocarpa
MPAGHGLRSRTRDLFARPFRKKGYIPLTTYLRTYKVGDYVDIKVNGAVHKGMPHKFYHGRTGRVWNVTKRAIGVVINKQVGNRIIGKRIHVRVEHVQPSRCREEFKLRKKKNDELKAEAKARGEKISTKRQPQGPKPGFMVEGATLETFTPIPYDVVNDLKGGY

SEQ ID NO: 15168 - DNA, 495 bp, Populus trichocarpa
  CDS (1)..(495)
atgccggctggacacggtgtgcgatcaaggaccagagatctcttcgctcgtcccttcaggaagaagggttacatccccctctccacttatctcagaacatacaaggtaggcgactatgtcgacgtcaaggtaaacggcgccgttcacaaaggcatgccccacaagttctaccatggccgcaccggtcgcgtctggaatgtcaccaagcgcgctattggtgtcgtcatcaacaagcaggttgggaataggattattgggaagaaaattcatgttagggtggagcatgtgcagccgtcgaggtgcagggaggagtttaagttgaggaagaagaagaatgatgagttgaaggctgaggccaaagcttgtggtgaaaagattagcactaagaggcagcctcaaggacctaagcctggatttatgttggagggtgctactcttgaaactgtcactcccattccttatgatgtggtcaatgatctcaagggtggttattga

SEQ ID NO: 15169 - protein, 164 aa, Populus trichocarpa
MPAGHGVRSRTRDLFARPFRKKGYIPLSTYLRTYKVGDYVDVKVNGAVHKGMPHKFYHGRTGRVWNVTKRAIGVVINKQVGNRIIGKKIHVRVEHVQPSRCREEFKLRKKKNDELKAEAKACGEKISTKRQPQGPKPGFMLEGATLETVTPIPYDVVNDLKGGY

SEQ ID NO: 15170 - DNA, 495 bp, Populus jackii
  CDS (1)..(495)
atgccggctggtcacggtctccggtctcgcacaagagatctctttgctcgtcccttcagaaagaagggttacattccattgacaacctacctcagaacctacaagattggagacaatgtagacatcaaggttaacggcgctgtccacaagggtatgcctcacaagttctaccatggacgtactggacgtgtctggaatgtcaccaaacgcgccatcggcgtcgagatcaacaagcaggtgggtaacagaatcattaggaagaggatccatgtaagagtggagcatttgctgccttcaaggtgcactgaggaatttcgtctcaggaagaagaagaatgatcaactgaaggcagaggctaaggccagaggtgaggttatcagcacaaagaggcagccacagggtcccaaacctggtttcatggtggaaggtgcgacattggaaactgttacacccattccatatgatgttgttaatgatctcaagggcggttactag

SEQ ID NO: 15171 - protein, 164 aa, Populus jackii
MPAGHGLRSRTRDLFARPFRKKGYIPLTTYLRTYKIGDNVDIKVNGAVHKGMPHKFYHGRTGRVWNVTKRAIGVEINKQVGNRIIRKRIHVRVEHLLPSRCTEEFRLRKKKNDQLKAEAKARGEVISTKRQPQGPKPGFMVEGATLETVTPIPYDVVNDLKGGY

SEQ ID NO: 15172 - DNA, 544 bp, Lineus viridis
  CDS (22)..(504)
ggccacagctgagaaaccatcatgactaaccccaaaggatatcgccgtggtactcggtacatgttctcccgtcaattcaaaaagaagggagtaactcatctatccaaatacttgaagtgctacagacggggagacatcgtcgacatcaagggtgatggtgctatccaaaagggtatgccacacaaatcctaccacggcagaacaggccgcgtttacaatgtcacacaacacgctgttggtgtcattgtgaataagagagtaaggggcaagatcctagctaagcgtatcaacctgcgcattgagcatgttaagcactccaactgtaggctggacttccttaaccgtgtgaagaggaatgaggttatcaagagggaggcacgagtgaagggcgtcaagccagagtgcaagagattgcctcaaggacctaagaaagcccactttgtgcggacgaaaggtaatctgccacaggtgtttgagccaattccatacgaatttgtggcgtaaactgtatacattgttgtaaaaattaaaaaaagattgaaaa

SEQ ID NO: 15173 - protein, 160 aa, Lineus viridis
MTNPKGYRRGTRYMFSRQFKKKGVTHLSKYLKCYRRGDIVDIKGDGAIQKGMPHKSYHGRTGRVYNVTQHAVGVIVNKRVRGKILAKRINLRIEHVKHSNCRLDFLNRVKRNEVIKREARVKGVKPECKRLPQGPKKAHFVRTKGNLPQVFEPIPYEFVA

SEQ ID NO: 15174 - DNA, 507 bp, Ostreococcus tauri
  CDS (1)..(507)
atgggtaaccaacgcgctcggtcccgcggtctccgccacggtacccgtaacctcttctcccgcggtcaccgtgagcacggtacgttgaacaccacgacgtacctgcgcacgttccgtgtcggtgactatgtcgacatcaaggtgaactcggcgcaacaaaagggtatgccgtacttgcagtaccaaggcagaacgggtcaagtgtggaacgtgacgccgcgcgcggtgggtgtggagatcaacaagcagatcggcggtcgcattgctcgtaagcgcatccacgtgcgcatcgagcacgtgcaacactctcgatgccgtgaggatttcatcgctcgtcgcgaagcgaacgacaaggcgcaccacgaggctcacttggctggcaagaagatcacgacgaagcgtgaggtcacgggccaaccgcgtacgggtttcaccctcgagaacgtcaagtcggagctcttgacgccgatcccgtacgacatcttgcgtgaaggcatgaagtactaa

SEQ ID NO: 15175 - protein, 168 aa, Ostreococcus tauri
MGNQRARSRGLRHGTRNLFSRGHREHGTLNTTTYLRTFRVGDYVDIKVNSAQQKGMPYLQYQGRTGQVWNVTPRAVGVEINKQIGGRIARKRIHVRIEHVQHSRCREDFIARREANDKAHHEAHLAGKKITTKREVTGQPRTGFTLENVKSELLTPIPYDILREGMKY

SEQ ID NO: 15176 - DNA, 480 bp, Solanum tuberosum
  CDS (1)..(480)
atgccggccggtcatggtttgaggtctcgaacgagagattcattctctcgtgctttcaggaagaagggtaccatcgcactttcaacctacttgaggattttcaaaatcggagattatgttgatatcaaggtgaatggtgctattcacaagggaatgcctcacaagttctaccatggacgtactggtcgtgtttggaatgttaccaaacgtgccgttggtgttgaagtcaacaagcaggttcgtaacaagatcttaagaaagaggatccatgtgaggattgagcatgtccagcaatctcgatgcactgaagaagtcagggaaaggattaagaagaatgatcaactaaaggctgatgccaaggctagaggagaaatcatcagcacaaaaagacaaccactcggacccaaaccagggtttatggttggaggtgctactttggagacagttacccccataccatatgatgtggttatgatttga

SEQ ID NO: 15177 - protein, 159 aa, Solanum tuberosum
MPAGHGLRSRTRDSFSRAFRKKGTIALSTYLRIFKIGDYVDIKVNGAIHKGMPHKFYHGRTGRVWNVTKRAVGVEVNKQVRNKILRKRIHVRIEHVQQSRCTEEVRERIKKNDQLKADAKARGEIISTKRQPLGPKPGFMVGGATLETVTPIPYDVVMI

SEQ ID NO: 15178 - DNA, 495 bp, Solanum tuberosum
  CDS (1)..(495)
atgccggccggtcatggtttgaggtctcgaacgagagattcattctctcgcgccttcaggaagaagggtaccatcgcactttcaacctacttgaggattttcaaaatcggagattatgttgatatcaaggtgaatggtgctattcacaagggaatgcctcacaagttctaccatggacgtactggtcgtgtttggaatgttaccaaacgcgccgttggtgttgaagtcaacaagcaggttcgtaacaagatcttaagaaagaggatccatgtgaggattgagcacgtccagcaatctcgatgcactgaagaagtcagggaaaggattaagaagaatgatcaactaaaggctgatgccaaggctagaggagaagtcatcagcacaaaaagacaaccactcggacccaaaccagggttcatggttggaggtgctactttggagacagttacccccataccatatgatgtggttaatgatttgaagggaggttattga

SEQ ID NO: 15179 - protein, 164 aa, Solanum tuberosum
MPAGHGLRSRTRDSFSRAFRKKGTIALSTYLRIFKIGDYVDIKVNGAIHKGMPHKFYHGRTGRVWNVTKRAVGVEVNKQVRNKILRKRIHVRIEHVQQSRCTEEVRERIKKNDQLKADAKARGEVISTKRQPLGPKPGFMVGGATLETVTPIPYDVVNDLKGGY

SEQ ID NO: 15180 - DNA, 486 bp, Ixodes scapularis
  CDS (1)..(486)
atggtgaacaccaagggttaccggagaggaacgcgctacctcttcgccaggggcttcaggaagcatggcgtcgagcacctctctaccttccttcaggtctacaagcggggagactacgttgacgttaagggcaacggagccttccaaaagggtatgccgcacaaattctaccacggcaagacgggccgagtgttcaacgtgacgccacacggtgtcggcgtcatcgtcaacaagcgcgtccggcaccgcatcattcccaagcgcatcaacctgcgcattgaacatgtgaagcactccaagtgccgccaggacttcctggaaagggccaagaagaaccgtgagctgcgcaaggaagccaaaaaggccggcatcaaggtctgctgcaagcgacagcccgagggtccccggccagcgcacttcgtgaagctgaacggaagacaggagccagagttgctgcagcccctgccatacgagttcatcgcctag

SEQ ID NO: 15181 - protein, 161 aa, Ixodes scapularis
MVNTKGYRRGTRYLFARGFRKHGVEHLSTFLQVYKRGDYVDVKGNGAFQKGMPHKFYHGKTGRVFNVTPHGVGVIVNKRVRHRIIPKRINLRIEHVKHSKCRQDFLERAKKNRELRKEAKKAGIKVCCKRQPEGPRPAHFVKLNGRQEPELLQPLPYEFIA

SEQ ID NO: 15182 - DNA, 480 bp, Lysiphlebus testaceipes
  CDS (1)..(480)
atgacaaattccaaaggttatcgtcgtggtacgagagatttgttttctcgtaaattccgtaatcatggaacaattccattgtctacgtatatgaaagtatacaaagtcggagatattgtagacatcaagggaaatggtgctgttcagaagggtatgccctacaaggtataccatggtaaaactggtagagtttttaacgttgcacctcatgcagtaggtgtcatcgtcaacaaacgtgttcgtggcaatattcttgctaaacgtattaatgtacgtattgagcatgttacacactcaaaatgtcgtgaagactttttgaaacgtgtaaaacaaaatgaaaaattaagaaaagaagccaaggaaaagaaggttgctgttcaactcaaaagacaaccaaaacaaccatcaaaagcacatattgtatcaggaagagaagcaccaattgttcttgctccaatcccatatgaatttattgcttaa

SEQ ID NO: 15183 - protein, 159 aa, Lysiphlebus testaceipes
MTNSKGYRRGTRDLFSRKFRNHGTIPLSTYMKVYKVGDIVDIKGNGAVQKGMPYKVYHGKTGRVFNVAPHAVGVIVNKRVRGNILAKRINVRIEHVTHSKCREDFLKRVKQNEKLRKEAKEKKVAVQLKRQPKQPSKAHIVSGREAPIVLAPIPYEFIA

SEQ ID NO: 15184 - DNA, 480 bp, Culicoides sonorensis
  CDS (1)..(480)
atgactaggactcatggttatcgtcgtggaacgagagacatgttctctcgccccttccgcaagcacggagttatcccattgtccacatatatgaaagtatacaaatgtggagactatgttgatatcaagggtcatggtgcagttcataaaggaatgccttttaaagcttaccatggtaaaactggtcgtgtttacaatgtgaccaaacacagtttaggtgtcatagtaaacaaaagacaccgtggaaagattctccccaagcgaatcaatgttcgtgttgaacatgtggaacaatcaaggtgtcgtcaagactttttgcgtcgcgtaaaggaaaacgatcaaaagaaacgtgaagctcgcgccaagaaacaaaaagtcatctgtaaacgtaagcctgtggaaccttcagaagctaaagtaattgaaaatccaccagaaccaattaaactggctccaattccatatgaattcattgcttaa

SEQ ID NO: 15185 - protein, 159 aa, Culicoides sonorensis
MTRTHGYRRGTRDMFSRPFRKHGVIPLSTYMKVYKCGDYVDIKGHGAVHKGMPFKAYHGKTGRVYNVTKHSLGVIVNKRHRGKILPKRINVRVEHVEQSRCRQDFLRRVKENDQKKREARAKKQKVICKRKPVEPSEAKVIENPPEPIKLAPIPYEFIA

SEQ ID NO: 15186 - DNA, 480 bp, Heliothis zea
  CDS (1)..(480)
atgacgaactccaagggttatcgtcgcggaaccagggatttgttcgcccgcagattccgcactcatggaaccatcccgctgtccacgtacatgaaagtgtacaaagtcggcgacatcgttgacatcaggggtaatggtgcagtccagaagggtatgccccacaaagcttaccacggaaagactggccgtgtatacaatgtcacacagcacgctcttggagtgattgtgaacaagcgtgtccgcggaaggatcctacccaagcgcatcaacgtccgcattgaacacatcaagcactccaagtgcagacaggatttcctcaagagggtgaaggagaacgagaggctcctggctgaggccaaggccgctggcaagatcgctaacctcaagagacaacctgccggacctaagcccgctcacattgtcagtggtactgagaaaccagtgctattggctcccatcccctatgagtttgtagcttaa

SEQ ID NO: 15187 - protein, 159 aa, Heliothis zea
MTNSKGYRRGTRDLFARRFRTHGTIPLSTYMKVYKVGDIVDIRGNGAVQKGMPHKAYHGKTGRVYNVTQHALGVIVNKRVRGRILPKRINVRIEHIKHSKCRQDFLKRVKENERLLAEAKAAGKIANLKRQPAGPKPAHIVSGTEKPVLLAPIPYEFVA

SEQ ID NO: 15188 - DNA, 480 bp, Plutella xylostella
  CDS (1)..(480)
atgacgaactccaagggttaccgccgcggtactagggacctgttcgcccgcaggttccgcacacatggaaccatctccctgtccacgtacatgaaagtgtacaaagttggagatatcgtcgacatcaggggcaacggtgcagtccagaagggtatgccacacaaagtgtaccacggaaagactggtcgcgtttacaacgtcacagcccacgctcttggcgtcatcgtcaacaagcgagtacgtggcaggattctacccaagaggatcaacatccgcattgagcacgtcaagcactccaagtgccgtcaggacttcctcacccgtgtcaaggagaacgagaggctgctgaaggaagccaaggctgccggcaaggtcgccaagctaaagagacagcccgcacagcccaagcccgcgcacatagtgagcggagacgagaagcctgtgctcctcgcccccatcccctatgagtttgtagcttaa

SEQ ID NO: 15189 - protein, 159 aa, Plutella xylostella
MTNSKGYRRGTRDLFARRFRTHGTISLSTYMKVYKVGDIVDIRGNGAVQKGMPHKVYHGKTGRVYNVTAHALGVIVNKRVRGRILPKRINIRIEHVKHSKCRQDFLTRVKENERLLKEAKAAGKVAKLKRQPAQPKPAHIVSGDEKPVLLAPIPYEFVA

SEQ ID NO: 15190 - DNA, 483 bp, Oikopleura dioica
  CDS (1)..(483)
atgaccaaccctaaaggtactcgtcggggtacccgatacatgttctccaaggacttccgaaagaagggaaccattggcttgaagacctacttcgccaactaccacaagggagacatcgtcgacatcaagggtgatggtgccttccagaagggtatgccgcacaaggtctaccacggaaccaccggtcgagtgttcaacgtttctcgaaaggccgtcggtgttatcgtcaacaagaagcacaacggacgaatcatcgccaagcgaatcaacctccgaatcgagcacgtccgacactccaagtcgcgacagggtttccttgaccgagtcgtcgccaacaacgcccgcatcgctgaggccaagaaggctggcaccttcgttgatgtcaagcgaatcaacgtccagccccgacccgctcacaccgtcaaacttttcggcaaagaacccgagatggtcgctcctattccatacgaattccttatctaa

SEQ ID NO: 15191 - protein, 160 aa, Oikopleura dioica
MTNPKGTRRGTRYMFSKDFRKKGTIGLKTYFANYHKGDIVDIKGDGAFQKGMPHKVYHGTTGRVFNVSRKAVGVIVNKKHNGRIIAKRINLRIEHVRHSKSRQGFLDRVVANNARIAEAKKAGTFVDVKRINVQPRPAHTVKLFGKEPEMVAPIPYEFLI

SEQ ID NO: 15192 - DNA, 486 bp, Ornithodoros moubata
  CDS (1)..(486)
atggtgaacacgaagggttaccggagaggcactaggtacctcttcgcccggaaattcaggcgacacggcgtagagcatctgtctacctatctgcaggtctacaagcgaggtgactatgttgatattaagggtaacggagccttccagaaaggcatgccattcaagttctatcatgggaagaccggtaaggttttcaacgtgactccccacgccgtcggagtcattgtcaacaagcgggtcaggcaccgcatcatcccaaagcgtatcaacgtccgcattgaacacattaagcactccaactgccgtaaagaatacctggaacgtatcaagaagaatcgcgttctcagggaagaagccaagaaggctggcatcaagatatgtttaaaaagacagccggagggcccaaggcctgggcactttgtgaagttgaatggaaaacaggagccagaattggtgcagcccctgccttatgagttcattgcctga

SEQ ID NO: 15193 - protein, 161 aa, Ornithodoros moubata
MVNTKGYRRGTRYLFARKFRRHGVEHLSTYLQVYKRGDYVDIKGNGAFQKGMPFKFYHGKTGKVFNVTPHAVGVIVNKRVRHRIIPKRINVRIEHIKHSNCRKEYLERIKKNRVLREEAKKAGIKICLKRQPEGPRPGHFVKLNGKQEPELVQPLPYEFIA

SEQ ID NO: 15194 - DNA, 483 bp, Branchiostoma belcheri tsingtauense
  CDS (1)..(483)
atgacgaacggccatggttatcgccgcggtacgcggtatatgttcagccgcaaattcagggcacgtggtcccatccatctgtccacctacctccatgtctacaagcgcggtgacatcgtggacgtcaagggcacgggtactgtgcagaagggcatgccttacaaggcctaccacggccgcactgggcggatcttcaacgtcacaaatcacgcagttggtgtcatcgtcaacaagagagtagggaaccgcgtcatcccgaagcgcatcaacctccgcgtggagcacgtgaagcactcccgctccagggaggacttcctcaagcgcgtcaagaagaacgatgagctgaagaagaagcacaaggaaactggcgtctcccaggtcttgaaaagagagcccggtggaccccgtgccggccacatggtaagcaccaacaacaacgtgccccagctggtggagcccatcccatacgagttcatcgcatag

SEQ ID NO: 15195 - protein, 160 aa, Branchiostoma belcheri tsingtauense
MTNGHGYRRGTRYMFSRKFRARGPIHLSTYLHVYKRGDIVDVKGTGTVQKGMPYKAYHGRTGRIFNVTNHAVGVIVNKRVGNRVIPKRINLRVEHVKHSRSREDFLKRVKKNDELKKKHKETGVSQVLKREPGGPRAGHMVSTNNNVPQLVEPIPYEFIA

SEQ ID NO: 15196 - DNA, 483 bp, Aequipecten irradians
  CDS (1)..(483)
atgaccaacacaaagggatataggcgcggtacgcgctacatgttctctcgtcaattcaagacaaagggagtcattccattgtctacgtatatgaaaatatacagaagaggagacatcgtcgatgttaagggccacggagctgtacagaagggtatgccccacaaggtctaccacggaaagactggccgagtattcaatgtcactcctcacgctgttggtgttgttgtaaacaagcgtgtcggacaccgagttctgcccaagagaatcaacttgaggattgaacacgtgaaacactcaaactgtcgtctggacttcgtgaagcgtgtgaaggaaaacgccgaaaagaagaaggaggctaaggagaagggaatcatgcttagcttgaaacgccagcctaaacagcccaacacatcccactttgtgaggacgaaatacaacaagcctcagctgattgaaccaattccatacgagttcattgcctag

SEQ ID NO: 15197 - protein, 160 aa, Aequipecten irradians
MTNTKGYRRGTRYMFSRQFKTKGVIPLSTYMKIYRRGDIVDVKGHGAVQKGMPHKVYHGKTGRVFNVTPHAVGVVVNKRVGHRVLPKRINLRIEHVKHSNCRLDFVKRVKENAEKKKEAKEKGIMLSLKRQPKQPNTSHFVRTKYNKPQLIEPIPYEFIA

SEQ ID NO: 15198 - DNA, 480 bp, Spodoptera frugiperda
  CDS (1)..(480)
atgacgaactccaagggttatcgccgcggaactagggatttgttcgcccgcagattccgcacccatggaaccatccccctttcgacgtacatgaaagtgtacaaagtcggagacatcgttgacatcaggggtaatggtgcagtccagaagggtatgccccacaaagtctaccacggaaagactggccgtgtctacaatgtcacacaacacgctctgggcatcatcgtgaacaagcgtgtccgcggaaggatcctacctaagcgcatcaacgtccgcattgagcacatcaagcactccaagtgcagacaggacttcctcaagagggtgaaggagaatgagaggctcctgaaggaagctaaggctgccggcaagatcgtcaacctcaagagacaaccagctggacccaagcctgctcatattgtcagtggcactgagaaaccagtgttattggctcccatcccctatgagtttgtagcttaa

SEQ ID NO: 15199 - protein, 159 aa, Spodoptera frugiperda
MTNSKGYRRGTRDLFARRFRTHGTIPLSTYMKVYKVGDIVDIRGNGAVQKGMPHKVYHGKTGRVYNVTQHALGIIVNKRVRGRILPKRINVRIEHIKHSKCRQDFLKRVKENERLLKEAKAAGKIVNLKRQPAGPKPAHIVSGTEKPVLLAPIPYEFVA

SEQ ID NO: 15200 - DNA, 495 bp, Oryza sativa
  CDS (1)..(495)
atgccggcggaccacgggctgcgtgcgcggacgcgcgacctgttcgcgcggccgttcaggaagaaggggtacatcccgctcaccacctacctccgcacctacaagatcggcgagcacgtcgacgtcaaggtgaacggcgccgtgcacaaggggatgccgcacaagttctaccacggccgcaccggccgcgtctggaacgtcaccaagcgcgccatcggcgtcgagatcaacaagcaggttgggaaccgcattatcaggaagaggatccatgtccgtgtggagcatgtgcagccatccaggtgcactgaggagttccgcctgaggaagatcaagaacgaccagctcaaggcagatgccaaggctcgtggtgaggtcatcagcacgaagaggcagccgcagggtcctaagcctggcttcatggttgagggtgcaacactggagactgtcacccccatcccgtacgatgtggtcaatgatctcaagggtggttactag

SEQ ID NO: 15201 - protein, 164 aa, Oryza sativa
MPADHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 15202 - DNA, 495 bp, Arabidopsis thaliana
  CDS (1)..(495)
atgccggctggacatggagttcgagcgagaacgagggatctgttcgcgaggcctttcaggaagaagggttacattcctctatcgacttacctgaggaccttcaaggtcggcgattacgtcgatgtgaaggtgaatggtgcgatccacaagggtatgcctcacaagttctaccatggtcgtactggtcgtatctggaacgtcaccaagcgcgccgtcggtgttgaagtcaacaaacagattgggaacaggatcataaggaagaggattcatgttcgtgtggagcatgtgcagcagtcaagatgtgccgaggagttcaagctgaggaagaagaaaaacgatgagctcaaggctgcagccaaagccaatggtgagaccatcagcaccaagagacagcctaaaggacccaaaccaggattcatggtcgaaggaatgaccttggagactgtcactccaatcccctacgatgtcgtcaacgatctcaaaggaggctattag

SEQ ID NO: 15203 - protein, 164 aa, Arabidopsis thaliana
MPAGHGVRARTRDLFARPFRKKGYIPLSTYLRTFKVGDYVDVKVNGAIHKGMPHKFYHGRTGRIWNVTKRAVGVEVNKQIGNRIIRKRIHVRVEHVQQSRCAEEFKLRKKKNDELKAAAKANGETISTKRQPKGPKPGFMVEGMTLETVTPIPYDVVNDLKGGY

SEQ ID NO: 15204 - DNA, 495 bp, Arabidopsis thaliana
  CDS (1)..(495)
atgccggcgggacacggagtgagggcgagaacaagagatctgttcgcgagaccattcaggaagaagggttatattccactctccacttacctcagaaccttcaaggtcggcgattacgtcgatgtcaaggttaatggagctatccacaagggtatgcctcataagttctaccatggtcgtactggtcgcatctggaatgtcactaagcgtgccgttggtgttgaagtcaacaaacagattgggaacagaatcataaggaagaggatacatgtgcgtgtggagcatgtgcaacagtcaaggtgtgctgaggagtttaaactcagaaagaagcagaacgatgtgcttaaggctgatgctaaagccagaggagagactatcagcaccaagagacagcctaaaggtcctaaaccgggtttcatggtcgaaggtatgacattggagactgtcactcccattccttacgatgttgtcaacgatctcaagggtggttattga

SEQ ID NO: 15205 - protein, 164 aa, Arabidopsis thaliana
MPAGHGVRARTRDLFARPFRKKGYIPLSTYLRTFKVGDYVDVKVNGAIHKGMPHKFYHGRTGRIWNVTKRAVGVEVNKQIGNRIIRKRIHVRVEHVQQSRCAEEFKLRKKQNDVLKADAKARGETISTKRQPKGPKPGFMVEGMTLETVTPIPYDVVNDLKGGY

SEQ ID NO: 15206 - DNA, 483 bp, Schizosaccharomyces pombe
  CDS (1)..(483)
atgcctcattcctatggtattagagctcgtacccgctacacttttcagcgtggtttcagggagcatggtcagatccgtttgtccacttacttgaaaacttacaaagttggtgatattgtcgacattaaggtcaatggtgctgtccagaagggtatgcctcacaagtattaccatggtaagactggtgtcgtttacaacgttactcaatcatccgttggtgtcttgatctacaaggttgttggtaaccgttacatggaaaagcgtgtcaatgttcgtattgagcacgttaagcattccaagtgccgtcaagacttcttggaccgtgtcaaggccaacgaggctaagcgtaaggaggccaaggctcagggtaagactgttcaacttcgtcgtcaacccgctcctcccgccaaggctcattttgtttccactgagaacaacgagcctgtcactcttcaccccgttgcctatgatactaccatttaa

SEQ ID NO: 15207 - protein, 160 aa, Schizosaccharomyces pombe
MPHSYGIRARTRYTFQRGFREHGQIRLSTYLKTYKVGDIVDIKVNGAVQKGMPHKYYHGKTGVVYNVTQSSVGVLIYKVVGNRYMEKRVNVRIEHVKHSKCRQDFLDRVKANEAKRKEAKAQGKTVQLRRQPAPPAKAHFVSTENNEPVTLHPVAYDTTI

SEQ ID NO: 15208 - DNA, 483 bp, Schizosaccharomyces pombe
  CDS (1)..(483)
atgcctcattcttacggtatcagagctcgcacccgttacacctttcaacgtggtttcagagagcatggtcaaattcgtttgtccacttatttgaagacctataaggttggtgacattgtcgacattaaggttaatggtgctgtccaaaagggtatgcctcacaagtactaccatggcaagactggtgttgtttacaacgttactcaatcttctgttggtgtcttgatctacaaggttgttggtaaccgctacatggagaagcgtgtcaatgttcgtattgagcacgttaagcactctaagtgccgtcaagacttcttggaccgtgttaaggccaatgaggctaagcgtaaggaggccaaggctcagggtaagactgttcaacttcgtcgtcaacctgctcctcctgctacggctcatttcgtttctactgagaataacgagcccgtcactctccaccccgtcgcctatgatactactatctag

SEQ ID NO: 15209 - protein, 160 aa, Schizosaccharomyces pombe
MPHSYGIRARTRYTFQRGFREHGQIRLSTYLKTYKVGDIVDIKVNGAVQKGMPHKYYHGKTGVVYNVTQSSVGVLIYKVVGNRYMEKRVNVRIEHVKHSKCRQDFLDRVKANEAKRKEAKAQGKTVQLRRQPAPPATAHFVSTENNEPVTLHPVAYDTTI

SEQ ID NO: 15210 - DNA, 483 bp, Saccharomyces cerevisiae
  CDS (1)..(483)
atgggtaaatcacatggttacagatctcgtacacgttacatgttccaacgtgacttcagaaagcatggtgccgttcacatgtccacctacttgaagatctacaaggttggtgacattgtcgacatcaaagccaatggttctatccaaaagggtatgccacacaagttctaccaaggtaagaccggtgtcgtctacaacgttaccaagtcttctgttggtgttatcatcaacaagatggtcggtaacagatacttggaaaagagattgaacttgagagttgaacacatcaagcactctaaatgtagacaagaatttttggaaagagttaaggccaatgctgctaagcgtgctgaagccaaggcccaaggtgttgctgtccaattgaagagacaaccagctcaaccaagagaatcccgtattgtctctactgaaggtaacgttcctcaaactttagctccagttccatacgaaaccttcatttaa

SEQ ID NO: 15211 - protein, 160 aa, Saccharomyces cerevisiae
MGKSHGYRSRTRYMFQRDFRKHGAVHMSTYLKIYKVGDIVDIKANGSIQKGMPHKFYQGKTGVVYNVTKSSVGVIINKMVGNRYLEKRLNLRVEHIKHSKCRQEFLERVKANAAKRAEAKAQGVAVQLKRQPAQPRESRIVSTEGNVPQTLAPVPYETFI

SEQ ID NO: 15212 - DNA, 483 bp, Encephalitozoon cuniculi
  CDS (1)..(483)
atgaggagcaagggatacagaagaggaaccaggtatctattttcacaggaccacaggaagcacggagttgcacatgtgtcgaagtatctcgaaaagtacgagattggagacatggtggacattctagtcaatccggcgatgatgaaggggatgcctcacaagtactaccatgggaggacgggacgcgtgtatgatgtgaagcccaggtctctcaacgttgctctttacaagagggttcgtggaaagtatgtgatcaagaagatcattgtgcgtattgagcacgtgaggaagagtaggtgctcagaagagagccaaaagaggattcttatggctgcagaaatggcaagggatgccgagtcgagaggagtggtgcttgcaccttccaaaaggaagattgaaggcccgaggaaggcggtggaggtatcccttgataacaatcagcccattgaggtgggatacgagccccacgtggtgatcttctaa

SEQ ID NO: 15213 - protein, 160 aa, Encephalitozoon cuniculi
MRSKGYRRGTRYLFSQDHRKHGVAHVSKYLEKYEIGDMVDILVNPAMMKGMPHKYYHGRTGRVYDVKPRSLNVALYKRVRGKYVIKKIIVRIEHVRKSRCSEESQKRILMAAEMARDAESRGVVLAPSKRKIEGPRKAVEVSLDNNQPIEVGYEPHVVIF

SEQ ID NO: 15214 - DNA, 495 bp, Oryza sativa
  CDS (1)..(495)
atgccggcggggcacgggctgcgggcgcggacgcgcgacctcttcgcgcggccgttccgcaagaagggttacatcccgctcaccacctacctgaggacgtacaagatcggcgattacgtcgacgtcaaggtgaacggcgccgtgcacaagggcatgccgcacaagttctaccacggccgcaccggccgcgtctggaacgtcaccaagcgcgccatcggcgtcgagatcaacaagcaggtcggtaaccgcatcatcaggaagaggatccatgtccgtgtggagcatgtccagccatccaggtgcaccgaggagctccgcctgaggaaaatcaagaacgatcagctcaaggctgatgccaaggcccgtggtgaggttatcagcaccaagagacagcccgagggacccaaacctggtttcatggttgagggtgctacgctggagactgttacccccattccgtatgatgtggtcaatgatctcaagggtggttactag

SEQ ID NO: 15215 - protein, 164 aa, Oryza sativa
MPAGHGLRARTRDLFARPFRKKGYIPLTTYLRTYKIGDYVDVKVNGAVHKGMPHKFYHGRTGRVWNVTKRAIGVEINKQVGNRIIRKRIHVRVEHVQPSRCTEELRLRKIKNDQLKADAKARGEVISTKRQPEGPKPGFMVEGATLETVTPIPYDVVNDLKGGY

SEQ ID NO: 15216 - DNA, 495 bp, Oryza sativa
  CDS (1)..(495)
atgccggcgggccacgggctgcgtgcgcggacgcgcgacctgttcgcgcggccgttcaggaagaaggggtacatcccgctcaccacctacctccgcacctacaagatcggcgagcacgtcgacgtcaaggtgaacggcgccgtgcacaaggggatgccgcacaagttctaccacggccgcaccggccgcgtctggaacgtcaccaagcgcgccatcggcgtcgagatcaacaagcaggttgggaaccgcattatcaggaagaggatccatgtccgtgtggagcatgtgcagccatccaggtgcactgaggagttccgcctgaggaagatcaagaacgaccagctcaaggcagatgccaaggctcgtggtgaggtcatcagcacgaagaggcagccgcagggtcctaagcccggcttcatggttgagggtgcaacactggagactgtcacccccatcccgtacgatgtggtcaatgatctcaagggtggttactag

SEQ ID NO: 15217 - protein, 164 aa, Oryza sativa
MPAGHGLRARTRDLFARPFRKKGYIPLTTYLRTYKIGEHVDVKVNGAVHKGMPHKFYHGRTGRVWNVTKRAIGVEINKQVGNRIIRKRIHVRVEHVQPSRCTEEFRLRKIKNDQLKADAKARGEVISTKRQPQGPKPGFMVEGATLETVTPIPYDVVNDLKGGY

SEQ ID NO: 15218 - DNA, 495 bp, Brassica napus
  CDS (1)..(495)
atgccggcgggacatggagttcgtgctcgaacgagggatctgttcgcgagggggttcaggaagaagggtacaattccattgtccacgtacctcaggaccttcaaggtcggcgaatacgtcgatgttaaagtgaatggcgccatccacaagggtatgcctcacaagttctaccacggtcgtactggtcgtgtctggaacgttaccaaacgtgctgttggtgtcgaagtcaacaaacagattggaaacaggatcataaagaagaggcttcatgtgcgtgtggagcatgtgcagcagtctagatgtgcggaagagttcaaactgaggataaagaagaacgatgagctcaaagctgcagccaaagctagaggcgagacaataagcaccaagaggcagcctaaaggacccaaaccaggattcatggtcgaaggtatgaccttggagactgtcactcctatcccctacgacgtcgtcaacgacctcaagggaggctattag

SEQ ID NO: 15219 - protein, 164 aa, Brassica napus
MPAGHGVRARTRDLFARGFRKKGTIPLSTYLRTFKVGEYVDVKVNGAIHKGMPHKFYHGRTGRVWNVTKRAVGVEVNKQIGNRIIKKRLHVRVEHVQQSRCAEEFKLRIKKNDELKAAAKARGETISTKRQPKGPKPGFMVEGMTLETVTPIPYDVVNDLKGGY

SEQ ID NO: 15220 - DNA, 495 bp, Brassica napus
  CDS (1)..(495)
atgccggcgggtcatggagttcgcgcgaggacgagggatctgtttgctagagggttcaggaagaagggtacaatccccgggtcgacctacctcaggaccttcaaggtcggagaatacgtggatgttaaagtgaacggtgcgatccacaagggtatgcctcacaagttctaccatggtcgtaccggtcgtgtctggaacgttacgaaacgtgccgtcggtgtcgaagtcaacaaacagattggcaacaggatcattaagaagaggcttcatgtgcgtgtggagcacgtgcagcagtcaaggtgcgcagaggagttcaagctgaggattaagaagaacgatgagctcaaggctgcagccaaagccaaaggcgagacaataagcaccaagaggcagcctaaaggacccaaaccaggattcatggtcgaaggtatgaccttggagactgtcaccccaatcccttacgatgtcgtcaacgatctcaagggaggctattag

SEQ ID NO: 15221 - protein, 164 aa, Brassica napus
MPAGHGVRARTRDLFARGFRKKGTIPGSTYLRTFKVGEYVDVKVNGAIHKGMPHKFYHGRTGRVWNVTKRAVGVEVNKQIGNRIIKKRLHVRVEHVQQSRCAEEFKLRIKKNDELKAAAKAKGETISTKRQPKGPKPGFMVEGMTLETVTPIPYDVVNDLKGGY

SEQ ID NO: 15222 - DNA, 495 bp, Brassica napus
  CDS (1)..(495)
atgccggcaggtcatggagttcgcgctaggacgagggatctgttcgcgagggggttcaggaagaagggtacaatcccactgtcgacttacctcaggaccttcaaggtcggcgattacgtggatgtcaaggtgaacggtgcgatccacaagggtatgcctcacaagttctaccacggtcgtaccggtcgtgtctggaacgtcaccaagcgcgccgtcggtgtcgaagtcaacaaacagattggaaacaggatcattaggaagaggcttcatgtgcgtgtggagcatgtgcagcagtccaggtgcgcagaggagttcaagctgaggattaagaagaacgatgagctcaaggccgcagccaaagccagaggcgatacaataagcaccaagagacagcctaaaggccccaagccaggattcatggttgagggtatgaccttggagactgtcacccctatcccttacgacgtcgtcaacgatctcaagggaggctactag

SEQ ID NO: 15223 - protein, 164 aa, Brassica napus
MPAGHGVRARTRDLFARGFRKKGTIPLSTYLRTFKVGDYVDVKVNGAIHKGMPHKFYHGRTGRVWNVTKRAVGVEVNKQIGNRIIRKRLHVRVEHVQQSRCAEEFKLRIKKNDELKAAAKARGDTISTKRQPKGPKPGFMVEGMTLETVTPIPYDVVNDLKGGY

SEQ ID NO: 15224 - DNA, 495 bp, Brassica napus
  CDS (1)..(495)
atgccggcgggacatggagttcgtgctcgaacgagggatctgttcgcgagggggttcaggaagaagggtagaattcccgggtcgacctacctcaggaccttcaaggtcggcgattacgtcgatgttaaagtgaacggtgcgatccacaagggtatgcctcacaagttctaccacggtcgtaccggtcgtgtctggaacgtcaccaagcgagccgtcggtgttgaagtcaacaaacagattggcaacaggatcataaggaagaggcttcatgtgcgtgtggagcatgtgcagcagtcaaggtgtgcagaggagtttaagctgaggattaagaagaacgatgagctcaaggccgcagccaaagccagaggcgagacgataagcaccaagagacagcctaaaggccccaagccaggattcatggttgagggtatgaccttggagaccgtcactcctatcccttacgacgtcgtcaacgatctcaagggaggctattag

SEQ ID NO: 15225 - protein, 164 aa, Brassica napus
MPAGHGVRARTRDLFARGFRKKGRIPGSTYLRTFKVGDYVDVKVNGAIHKGMPHKFYHGRTGRVWNVTKRAVGVEVNKQIGNRIIRKRLHVRVEHVQQSRCAEEFKLRIKKNDELKAAAKARGETISTKRQPKGPKPGFMVEGMTLETVTPIPYDVVNDLKGGY

SEQ ID NO: 15226 - DNA, 495 bp, Helianthus annuus
  CDS (1)..(495)
atgccggctggtcacgggttacgctcaagaacaagggatttgttcgcaagagggttcaggaagaagggaaccatccatctctccacatacctcagaacctaccatgtcggagattacgtcgacatcaaggttaacggcgccgttcacaagggtatgccccacaagttctaccatggtcgcactggtcaggtctggaatgtcaccaagcgtgctattggagtcgagatgaacaaacaggttggtaacagaatcattaagaagaggattcatgtgcgaattgagcatgtgatgccatcaaggtgcaacgaagagttgaagcagaggatcaagaagaacgatcaactaaaggctgaggctaaggcgaagggtgtggtgatcagtactaagaggcagccgcttggacccaaaccgggatttatggttgaaggaaccaccctagagactgtgactcctattccttatgatgtggtcaatgatctcaagggtggatattaa

SEQ ID NO: 15227 - protein, 164 aa, Helianthus annuus
MPAGHGLRSRTRDLFARGFRKKGTIHLSTYLRTYHVGDYVDIKVNGAVHKGMPHKFYHGRTGQVWNVTKRAIGVEMNKQVGNRIIKKRIHVRIEHVMPSRCNEELKQRIKKNDQLKAEAKAKGVVISTKRQPLGPKPGFMVEGTTLETVTPIPYDVVNDLKGGY

SEQ ID NO: 15228 - DNA, 495 bp, Hordeum vulgare
  CDS (1)..(495)
atgccggcgggccatggtctgcggtcgcggacgcgcgacctgttcgcgcgccccttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgccgagatcaacaagcaggttggaaaccgcatcatcaggaaaaggatccatgtccgtgttgagcatgtgcagccatccaggtgtgctgaggagttccgcctgaggaaagtgaagaatgaccagctcaaggcggaagccaaggcacgtggtgaggtcatcagcaccaagaggcagccactcggccctaaacccgggttcatggtcgagggtaccacaatcgagaccgtcactcccattccttatgatgtggtcaatgatctcaagggtggttactag

SEQ ID NO: 15229 - protein, 164 aa, Hordeum vulgare
MPAGHGLRSRTRDLFARPFRKKGYIPLTTYLRTYKVGEYVDVKVNGAVHKGMPHKFYHGRTGRVWNVTKRAIGAEINKQVGNRIIRKRIHVRVEHVQPSRCAEEFRLRKVKNDQLKAEAKARGEVISTKRQPLGPKPGFMVEGTTIETVTPIPYDVVNDLKGGY

SEQ ID NO: 15230 - DNA, 498 bp, Oryza sativa
  CDS (1)..(498)
atgccggcggggcacgggctgcgggcgcggacgcgcgacctcttcgcgcggccgttccgcaagaagggttacatcccgctcaccacctacctgaggacgtacaagatcggcgattcccgggtcgacgtcaaggtgaacggcgccgtgcacaagggcatgccgcacaagttctaccacggccgcaccggccgcgtctggaacgtcaccaagcgcgccatcggcgtcgagatcaacaagcaggtcggtaaccgcatcatcaggaagaggatccatgtccgtgtggagcatgtccagccatccaggtgcaccgaggagctccgcctgaggaaaatcaagaacgatcagctcaaggctgatgccaaggcccgtggtgaggttatcagcaccaagagacagcccgagggacccaaacctggtttcatggttgagggtgctacgctggagactgttacccccattccgtatgatgtggtcaatgatctcaagggtggttactag

SEQ ID NO: 15231 - protein, 165 aa, Oryza sativa
MPAGHGLRARTRDLFARPFRKKGYIPLTTYLRTYKIGDSRVDVKVNGAVHKGMPHKFYHGRTGRVWNVTKRAIGVEINKQVGNRIIRKRIHVRVEHVQPSRCTEELRLRKIKNDQLKADAKARGEVISTKRQPEGPKPGFMVEGATLETVTPIPYDVVNDLKGGY

SEQ ID NO: 15232 - DNA, 495 bp, Zea mays
  CDS (1)..(495)
atgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagtgcggcgaggttatcagcaccaagaggcagccattgggtcccaagcccggcttcatggtcgagggcaccaccattgagaccgtaactcccatcccatatgatgtggtcaatgatctcaagggtggatactag

SEQ ID NO: 15233 - protein, 164 aa, Zea mays
MPAGHGLRSRTRDLFARPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKCGEVISTKRQPLGPKPGFMVEGTTIETVTPIPYDVVNDLKGGY

SEQ ID NO: 15234 - DNA, 483 bp, Triticum aestivum
  CDS (1)..(483)
atgggtcactcctacggaaagagagcgggcacccgctatgccttcagccgggacttccgcaagaagggtatgattgccctgaacacctacctccgacagtaccgcgttggagatatcgtcgacatcaaggcgaacggtgccgtccagaagggtatgcccttcaaggtctaccacggaaagactggtgtcatctacaacgtcaccaagtccgctgtcggtgtcatcatctacaagcaggtcaagcaccgatacatcgagaagcgaatcaacgtccgaatcgagcacatccagcagtcccgatctcgtgaggacttcctcaagcgagtcaaggctaacgccgaggccaagcgtgaggccaaggccaccggaaccgttgtccaggtcaagcgtcagcccattggacctcgtggcgcccacacactgtcgctctccgagaacccccccatgaccgttacccctcttgcctacgagaccacgatctaa

SEQ ID NO: 15235 - protein, 160 aa, Triticum aestivum
MGHSYGKRAGTRYAFSRDFRKKGMIALNTYLRQYRVGDIVDIKANGAVQKGMPFKVYHGKTGVIYNVTKSAVGVIIYKQVKHRYIEKRINVRIEHIQQSRSREDFLKRVKANAEAKREAKATGTVVQVKRQPIGPRGAHTLSLSENPPMTVTPLAYETTI

SEQ ID NO: 15236 - DNA, 495 bp, Triticum aestivum
  CDS (1)..(495)
atgccggcgggccacggtctgcggtcgcggacgcgcgacctgttcgcgcgcccgttccggaagaagggttacatcccgctcaccacctacctgcgcacctacaaggtcggcgagtacgtcgatgtcaaggtgaacggcgccgtgcacaagggtatgccgcacaagttctaccacggccgcaccggacgcgtgtggaacgtcaccaagcgcgccatcggcgtcgagatcaacaagcaggttggaaaccgcattatcaggaaaaggatccatgtccgtgttgagcatgtgcagccatccaggtgtgcggaggagttccgcctgaggaaagtgaagaatgaccagctcaaggaggaagccaaggcacgtggtgaggtcatcagcaccaagaggcagccgctcggccctaaacctgggttcatggttgagggtaccacaatcgagaccgtcactcccattccgtacgatgtggtcaatgatctcaagggtggttactag

SEQ ID NO: 15237 - protein, 164 aa, Triticum aestivum
MPAGHGLRSRTRDLFARPFRKKGYIPLTTYLRTYKVGEYVDVKVNGAVHKGMPHKFYHGRTGRVWNVTKRAIGVEINKQVGNRIIRKRIHVRVEHVQPSRCAEEFRLRKVKNDQLKEEAKARGEVISTKRQPLGPKPGFMVEGTTIETVTPIPYDVVNDLKGGY

SEQ ID NO: 15238 - DNA, 495 bp, Triticum aestivum
  CDS (1)..(495)
atgccgccgggccacggtctgcggtccggaccgcgcgacctgttcgcgcgcccgttccggaagaagggttacatcccgctcaccacctacctgcgcacctacaaggtcggcgagtacgtcgacgtcaaggtgaacggcgccgtgcacaagggtatgccgcacaagttctaccacggccgcaccggacgcgtgtggaacgtcaccaagcgcgccatcggcgttgagatcaacaagcaggttggaaaccgcattatcaggaaaaggatccatgtccgtgttgagcatgtgcagccatccaggtgtgctgaggagttccgcctgaggaaagtgaagaacgaccagctcaaggcggaagccaaggcgcgcggtgaggtcatcagcaccaagaggcagccgctcggccctaaacctgggttcatggtcgagggtaccacaattgagactgtcactcccattccctacgatgcgcccaatgatctcaagggtggttactag

SEQ ID NO: 15239 - protein, 164 aa, Triticum aestivum
MPPGHGLRSGPRDLFARPFRKKGYIPLTTYLRTYKVGEYVDVKVNGAVHKGMPHKFYHGRTGRVWNVTKRAIGVEINKQVGNRIIRKRIHVRVEHVQPSRCAEEFRLRKVKNDQLKAEAKARGEVISTKRQPLGPKPGFMVEGTTIETVTPIPYDAPNDLKGGY

SEQ ID NO: 15240 - DNA, 495 bp, Zea mays
  CDS (1)..(495)
atgccggcggggcacgggctgcggtcgcggacccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacagaggagttccgcctgaggaaagccaagaatgaccagctcaaggcggatgccaaggcccgcggtgaggtgatcagcaccaagaggcagcctgtgggacccaaacctggcttcatggttgagggtgctacactcgagacagtcactcctattccttatgatgtggtcaacgatctcaagggcggttactag

SEQ ID NO: 15241 - protein, 164 aa, Zea mays
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARGEVISTKRQPVGPKPGFMVEGATLETVTPIPYDVVNDLKGGY

SEQ ID NO: 15242 - DNA, 495 bp, Zea mays
  CDS (1)..(495)
atgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgaccagctgaaggcggatgcaaaggagcgcggcgaggtcatcagcaccaagaggcagccgttgggccccaagcctggcttcatggttgaggggactaccatcgagaccgtcactcccatcccgtacgatgtggtcaatgatcttaagggaggatactag

SEQ ID NO: 15243 - protein, 164 aa, Zea mays
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKVKNDQLKADAKERGEVISTKRQPLGPKPGFMVEGTTIETVTPIPYDVVNDLKGGY

SEQ ID NO: 15244 - DNA, 495 bp, Zea mays
  CDS (1)..(495)
atgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccatcccgctgcacagaagagttccgcctgaggaaggtgaagaatgaccagctgaaggcggatgcaaaggagcgcggcgaggtcatcagcaccaagaggcagccgttgggccccaagcctgtcttcatggttgaggggactaccatcgagaccgtcactcccatcccgtacgatgtggtcaatgatcttaagggaggatactag

SEQ ID NO: 15245 - protein, 164 aa, Zea mays
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKVKNDQLKADAKERGEVISTKRQPLGPKPVFMVEGTTIETVTPIPYDVVNDLKGGY

SEQ ID NO: 15246 - DNA, 495 bp, Zea mays
  CDS (1)..(495)
atgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagcgcggcgaggttatcagcaccaagaggcagccattgggtcccaagcccggcttcatggtcgagggcaccaccattgagaccgtaactcccatcccatatgatgtggtcaatgatctcaagggtggatactag

SEQ ID NO: 15247 - protein, 164 aa, Zea mays
MPAGHGLRSRTRDLFARPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKRGEVISTKRQPLGPKPGFMVEGTTIETVTPIPYDVVNDLKGGY

SEQ ID NO: 15248 - DNA, 411 bp, Zea mays
  CDS (1)..(411)
atgccggctggccacgggctgcgctcgcggacgcgcgacctgttcgcgcgccccttccgcaagaagggctacatcccgctcaccacctacctccgcaccggtcgcgtctggaacgtcaccaagcgcgccatcggcgtcgagataaacaagcaggtgaatggtcgcatcatcaggaagcgtatccatgtccgcgtggagcatgtgcagccatcccgctgcacagaagagttccgcctgaggaaggtgaagaatgaccagctgaaggcggatgcaaaggagcgcggcgaggtcatcagcaccaagaggcagccgttgggccccaagcctgtcttcatggttgaggggactaccatcgagaccgtcactcccatcccgtacgatgtggtcaatgatcttaagggaggatactag

SEQ ID NO: 15249 - protein, 136 aa, Zea mays
MPAGHGLRSRTRDLFARPFRKKGYIPLTTYLRTGRVWNVTKRAIGVEINKQVNGRIIRKRIHVRVEHVQPSRCTEEFRLRKVKNDQLKADAKERGEVISTKRQPLGPKPVFMVEGTTIETVTPIPYDVVNDLKGGY

SEQ ID NO: 15250 - DNA, 26 bp, Artificial sequence
  primer
atgggtaaatcacacggttacagatc

SEQ ID NO: 15251 - DNA, 26 bp, Artificial sequence
  primer
ttagatgaaagtttcgtatggaactg

SEQ ID NO: 15252 - protein, 174 aa, Artificial sequence
  consensus sequence
  Variant (2)..(4): Xaa in position 2 to 4 is any amino acid
  Variant (5)..(16): Xaa in position 5 to 16 is any or no amino acid
  Variant (18)..(18): Xaa in position 18 is any amino acid
  Variant (20)..(21): Xaa in position 20 to 21 is any amino acid
  Variant (24)..(25): Xaa in position 24 to 25 is any amino acid
  Variant (27)..(27): Xaa in position 27 is any amino acid
  Variant (29)..(29): Xaa in position 29 is any amino acid
  Variant (32)..(33): Xaa in position 32 to 33 is any amino acid
  Variant (35)..(35): Xaa in position 35 is any amino acid
  Variant (37)..(37): Xaa in position 37 is any amino acid
  Variant (39)..(39): Xaa in position 39 is any amino acid
  Variant (43)..(43): Xaa in position 43 is any amino acid
  Variant (44)..(47): Xaa in position 44 to 47 is any or no amino acid
  Variant (49)..(50): Xaa in position 49 to 50 is any amino acid
  Variant (51)..(51): Xaa in position 51 is any or no amino acid
  Variant (54)..(54): Xaa in position 54 is any amino acid
  Variant (56)..(56): Xaa in position 56 is any amino acid
  Variant (60)..(61): Xaa in position 60 to 61 is any amino acid
  Variant (66)..(66): Xaa in position 66 is any amino acid
  Variant (68)..(68): Xaa in position 68 is any amino acid
  Variant (72)..(72): Xaa in position 72 is any amino acid
  Variant (75)..(75): Xaa in position 75 is any amino acid
  Variant (77)..(77): Xaa in position 77 is any amino acid
  Variant (81)..(82): Xaa in position 81 to 82 is any amino acid
  Variant (84)..(84): Xaa in position 84 is any amino acid
  Variant (87)..(88): Xaa in position 87 to 88 is any amino acid
  Variant (91)..(91): Xaa in position 91 is any amino acid
  Variant (93)..(94): Xaa in position 93 to 94 is any amino acid
  Variant (96)..(98): Xaa in position 96 to 98 is any amino acid
  Variant (101)..(103): Xaa in position 101 to 103 is any amino acid
  Variant (105)..(105): Xaa in position 105 is any amino acid
  Variant (108)..(110): Xaa in position 108 to 110 is any amino acid
  Variant (112)..(112): Xaa in position 112 is any amino acid
  Variant (114)..(116): Xaa in position 114 to 116 is any amino acid
  Variant (118)..(119): Xaa in position 118 to 119 is any amino acid
  Variant (121)..(123): Xaa in position 121 to 123 is any amino acid
  Variant (125)..(130): Xaa in position 125 to 130 is any amino acid
  Variant (133)..(134): Xaa in position 133 to 134 is any amino acid
  Variant (135)..(137): Xaa in position 135 to 137 is any or no amino acid
  Variant (139)..(141): Xaa in position 139 to 141 is any amino acid
  Variant (142)..(144): Xaa in position 142 to 144 is any or no amino acid
  Variant (149)..(150): Xaa in position 149 to 150 is any amino acid
  Variant (151)..(151): Xaa in position 151 is any or no amino acid
  Variant (153)..(157): Xaa in position 153 to 157 is any amino acid
  Variant (159)..(167): Xaa in position 159 to 167 is any amino acid
  Variant (168)..(170): Xaa in position 168 to 170 is any or no amino acid
  Variant (172)..(172): Xaa in position 172 is any amino acid
MXXXXXXXXXXXXXXXGXRXXTRXXFXRXFRXXGXIXLXTYLXXXXXGXXXVDXKXNGAXXKGMPXKXYHGXTGXVXNVTXXAXGVXXNKXVXXRXXXKRXXXRXEHXXXSXCXXXFXXRXXXNXXXXXXAKXXXXXGXXXXXXKRQPXXXPXXXXXVXXXXXXXXXXXXPXPY

SEQ ID NO: 15253 - protein, 25 aa, Artificial sequence
  protein pattern
  Variant (3)..(3): Xaa in position 3 is Ile or Val
  Variant (5)..(5): Xaa in position 5 is Ala, Gly or Val
  Variant (6)..(6): Xaa in position 6 is any amino acid
  Variant (8)..(8): Xaa in position 8 is Ala or Ser
  Variant (9)..(9): Xaa in position 9 is Phe, Ile or Val
  Variant (10)..(10): Xaa in position 10 is any amino acid
  Variant (15)..(15): Xaa in position 15 is Phe, His or Tyr
  Variant (17)..(17): Xaa in position 17 is any amino acid
  Variant (19)..(19): Xaa in position 19 is any amino acid
  Variant (21)..(21): Xaa in position 21 is Lys or Arg
  Variant (24)..(24): Xaa in position 24 is any amino acid
  Variant (25)..(25): Xaa in position 25 is Ile or Val
VDXKXXGXXXKGMPXKXYXGXTGXX

SEQ ID NO: 15254 - protein, 24 aa, Artificial sequence
  protein pattern
  Variant (2)..(2): Xaa in position 2 is Ala, Gln or Ser
  Variant (3)..(3): Xaa in position 3 is Lys or Arg
  Variant (4)..(4): Xaa in position 4 is any amino acid
  Variant (6)..(8): Xaa in position 6 to 8 is any amino acid
  Variant (10)..(12): Xaa in position 10 to 12 is any amino acid
  Variant (14)..(14): Xaa in position 14 is any amino acid
  Variant (17)..(17): Xaa in position 17 is Phe, Leu or Met
  Variant (18)..(19): Xaa in position 18 to 19 is any amino acid
  Variant (20)..(20): Xaa in position 20 is Phe or Tyr
  Variant (21)..(21): Xaa in position 21 is His, Lys or Arg
  Variant (22)..(22): Xaa in position 22 is any amino acid
  Variant (24)..(24): Xaa in position 24 is Asp, Glu or Gln
FXXXFXXXGXXXLXTYXXXXXXGX

SEQ ID NO: 15255 - protein, 13 aa, Artificial sequence
  protein pattern
  Variant (2)..(2): Xaa in position 2 is Ile or Val
  Variant (5)..(5): Xaa in position 5 is Ile or Val
  Variant (6)..(7): Xaa in position 6 to 7 is any amino acid
  Variant (9)..(9): Xaa in position 9 is Lys or Arg
  Variant (10)..(10): Xaa in position 10 is Cys or Ser
  Variant (11)..(11): Xaa in position 11 is any amino acid
  Variant (12)..(12): Xaa in position 12 is Glu or Gln
  Variant (13)..(13): Xaa in position 13 is Asp or Glu
RXEHXXXSXXXXX

SEQ ID NO: 15256 - protein, 13 aa, Artificial sequence
  protein pattern
  Variant (4)..(5): Xaa in position 4 to 5 is any amino acid
  Variant (6)..(6): Xaa in position 6 is Ala or Ser
  Variant (7)..(7): Xaa in position 7 is Ile, Leu or Val
  Variant (10)..(10): Xaa in position 10 is any amino acid
  Variant (11)..(11): Xaa in position 11 is Ile, Met or Val
  Variant (12)..(12): Xaa in position 12 is any amino acid
NVTXXXXGVXXXK

SEQ ID NO: 15257 - DNA, 609 bp, Saccharomyces cerevisiae
  CDS (1)..(609)
atggccgaagaaagtaccgactttagtcaattcgaagaggagagaaacaacgatcagtataaagtttcagccaaaaaaactgttgacgaatacaaaaatctggatgctgaagacgaatccttggcgaaatggaaagagtctttgggtctaagttcagacgtcttgccattggaatttcccggtgacaaaaggaaggtggttgttcaaaaaattcaattactagtcaatacagaaccaaatcctatcacatttgatcttaccaacgaaaagacaatcaaagaactggcatctaaaagatacaaaattaaagaaaattctatttataagttgaagattgtgttcaaagttcaacatgaaattatcacagggttgcgatatgtccagtatatcaaaaaagcgggtattgccgttgacaagatagacgatcatttgggatcgtatgctcctaataccaagaccaaaccattttatgaggtggaactaccggaaagtgaagcacctagtgggtttttagcaagaggtaactacagtgccgtatcaaaattcattgatgatgataaaactaaccacttgactttaaattggggggtcgaaattgtcaaaaaataa

SEQ ID NO: 15258 - protein, 202 aa, Saccharomyces cerevisiae
MAEESTDFSQFEEERNNDQYKVSAKKTVDEYKNLDAEDESLAKWKESLGLSSDVLPLEFPGDKRKVVVQKIQLLVNTEPNPITFDLTNEKTIKELASKRYKIKENSIYKLKIVFKVQHEIITGLRYVQYIKKAGIAVDKIDDHLGSYAPNTKTKPFYEVELPESEAPSGFLARGNYSAVSKFIDDDKTNHLTLNWGVEIVKK

SEQ ID NO: 15259 - DNA, 800 bp, Zea mays
  CDS (128)..(718)
cattgggtacctcgaggccggccgggactcctccaattgaccctgaacttctccaccggattctctcgccgcctgttgccagccacacacaaccacccatccctctccatccaaccacacacccgccatggccgaccacgcagacgacctccacgccgagcagaccgaaggcttcaaggtcggagagaagaagacaatcgacgagtaccagaagctggaccagaatgacgagtctctgcaaaagtggaaggcgtcccttgggcttggccagggcaaggacatctccgaccccaacgacccccgcaagtgtatcattctatcccttggtctcgaggtagagggccgcgacgacatcatcatcgacctgcgtgctcctggtgcgctcgaggagctcgagaagaagcccttcaccatcaaggagggtgcgagtttccgcatgaaggcacagttcaaggtccagcacgagattctggcaggtctcaagtacctccagaaggtgaaccgcatgggtgttagcgccaagctgcaggagatgatgggctcatacggccccaacactgaggagaagccgttttacgagaagaagttcgagcccgaaaccgctccctctggcatgcttggtcgcggccactacacagccctttccaagttcgtcgacgacgacaaccaggtccacctgcagttcaagtggtctttcgacatcaagaaggactggtgataggcaatcggccaaatccgcatgttggaaaagggttgtattgtcgcacggcgcaatacggcagtctcttttagttgggagc

SEQ ID NO: 15260 - protein, 196 aa, Zea mays
MADHADDLHAEQTEGFKVGEKKTIDEYQKLDQNDESLQKWKASLGLGQGKDISDPNDPRKCIILSLGLEVEGRDDIIIDLRAPGALEELEKKPFTIKEGASFRMKAQFKVQHEILAGLKYLQKVNRMGVSAKLQEMMGSYGPNTEEKPFYEKKFEPETAPSGMLGRGHYTALSKFVDDDNQVHLQFKWSFDIKKDW

SEQ ID NO: 15261 - DNA, 750 bp, Glycine max
  CDS (1)..(750)
atgtctttggacattggggtggtctccaattgcaaaagcatgggttttgatgacgacaaaggcaaagacgttcctgaaacgcagcacgcggccgggaaaacggttcatgctcatgatgatgaaagtggcgatgaacgaggcacgagtctcagtagacacatgagtgaaggctccattgctgtcaccgaggatgaagatgaggacgtggagaggaggattgacttgggtccccagtgcaccttgaaagaacagcttgaaaaggataaggatgatgagagcttgaggaggtggaaggaacaacttcttggcagtgttgacatgacttctgttggtgaatctctggagccagaagtgaagatactgagccttgcaatcaaggcggctggtagagaagacattgttcttccaataccagaatcaggaaatcccagtggcttatggtttactttgaaagaaggtagccgttacagtctgatgttcactttccaggtcagccataatattgtttcaggtctcaaatacaccaatactgtatggaaaactggtctcaaggttgacagcactaaagagatgattggaacattcagccctcaggcagagccttacacgcatgagatgcccgaagagacaacaccatctgggttatttgctagagggcaatattcggctagatccaagtttgttgacgatgacaacaagttgtatttggagataaactacacttttgatattcggaaggactggctttag

SEQ ID NO: 15262 - protein, 249 aa, Glycine max
MSLDIGVVSNCKSMGFDDDKGKDVPETQHAAGKTVHAHDDESGDERGTSLSRHMSEGSIAVTEDEDEDVERRIDLGPQCTLKEQLEKDKDDESLRRWKEQLLGSVDMTSVGESLEPEVKILSLAIKAAGREDIVLPIPESGNPSGLWFTLKEGSRYSLMFTFQVSHNIVSGLKYTNTVWKTGLKVDSTKEMIGTFSPQAEPYTHEMPEETTPSGLFARGQYSARSKFVDDDNKLYLEINYTFDIRKDWL

SEQ ID NO: 15263 - DNA, 720 bp, Glycine max
  CDS (1)..(720)
atggagggtgctaactggaagataacagaggaagaagcagggccatcctcttcttctgggattgcttcaaataaacaacaaaacccacctgaaacttttcatcatcaacatcataggaaggaggctgcagcagaagaagaagaaaccgaggaagaggaagaagacgatgttgatcatcataacaatagcacctttgttcctggtcctctcctttctctcaaggatcagatcgaaaaagacaaggaggatgagagcctaaggagatggaaagagaagctgttgggttgcatggaaagtgatttagatggtcagatacatcctgaagtgaaattccactccattggaataatctctgaggattttggtgaagtcattactcctttatctgtggatgaaagccaaaatggtcatattctgtttactctcaaggagggctctcattatcagcttaagctaaaattcagtgttctgcacaacattgtgtctggtttggcatactgcaacaatgtgtggaaaggagggcttcaagttgaccagagcaaaggaatgttgggtacctttgctccccaaaaagaaccatatgtacataccttaaaagaagacatcactccgtctggtgtgcttgcaaggggtgtatactctgctaagattaagtttgaagatgatgacggaaggtgtcacatggaactcaaatattcattagagataaagaagaggtag

SEQ ID NO: 15264 - protein, 239 aa, Glycine max
MEGANWKITEEEAGPSSSSGIASNKQQNPPETFHHQHHRKEAAAEEEETEEEEEDDVDHHNNSTFVPGPLLSLKDQIEKDKEDESLRRWKEKLLGCMESDLDGQIHPEVKFHSIGIISEDFGEVITPLSVDESQNGHILFTLKEGSHYQLKLKFSVLHNIVSGLAYCNNVWKGGLQVDQSKGMLGTFAPQKEPYVHTLKEDITPSGVLARGVYSAKIKFEDDDGRCHMELKYSLEIKKR

SEQ ID NO: 15265 - DNA, 684 bp, Glycine max
  CDS (1)..(684)
atggggttcgatgaaaacaaagaaaccggagagaaaagtgatcatgcaaatgaagaacattataaaagtgaaggcgagcccttgagcaggcacgtgaatgagtcctctatccatgcaactgaagatgaggaggatgaagttggatccaaattacaattgggtcctcagtgcactcttaaagagcaccttgagaaagataaggatgatgagagtttaagaagatggaaggaacaactacttggaagtgtggatgtgaacaatgttgcagaaattctggaccctgaagtgaatattacttgtttgtctatcatctctcctgatagagatgacattgttctttccattcctgagaatgggaatccaaagggtttatggtttactcttaaagaaggttgtcattaccgcttgaaattcaccttccatgtgagcaataatattgtgtctggcttgaaatacaccaatactgtttggaagactggtgtcaaagtggatagctcaaaagagatgcttggaactttcagccctcaggcagagccttacacacatgagatgccagaagaaaccacaccctctgggctatttgcaagaggatcatattctgcaagatcaaagtttcttgatgatgacaacaaatgctacttggagatcaactatacttttgatattaggaaggaatgggcttga

SEQ ID NO: 15266 - protein, 227 aa, Glycine max
MGFDENKETGEKSDHANEEHYKSEGEPLSRHVNESSIHATEDEEDEVGSKLQLGPQCTLKEHLEKDKDDESLRRWKEQLLGSVDVNNVAEILDPEVNITCLSIISPDRDDIVLSIPENGNPKGLWFTLKEGCHYRLKFTFHVSNNIVSGLKYTNTVWKTGVKVDSSKEMLGTFSPQAEPYTHEMPEETTPSGLFARGSYSARSKFLDDDNKCYLEINYTFDIRKEWA

SEQ ID NO: 15267 - DNA, 738 bp, Glycine max
  CDS (1)..(738)
atgtctgctgctgtgtcctccacaacccctcatttagaggaagagctcaaaaacaaagcaacaaacaacaagaagaagaacaacgttggtggggaatcagaccagcccccttacaatgatggtgccaactctgatgttgctgaagaaactgagccagaggaagatgatgactccaagttggaatctaacaaagatttggatcttggccctcaattcactctcaaggaacagcttgagaaagacaaagatgatgaaagtttgagaaaatggaaggagcaacttctgggaagtgttgacatgtctgtcgttggaagtgaatgcaaagaccctgaagtgaagatattgagcctcattattacaagcccagataagcctgacctcaccctgccaattccatttactactgatcctaagaagagtcttttcatccttaaggaaggaagcaaatgccaaatgaaattcaccttcactgtctccaacaacatcgtttctggtctcaaatacacaaacgttgtttggaaaactggcgttagagtggacagcagaaaaaagatgttgggaacttttagtcctcagcaggaaccatatacatttgaattggaagaagaaactatcccttctggcatgttcgtcaggggaacctatgcagcaagaaccaagtttgtagacgacgatcgaaaatgctacttggatgtcaattactactttgaaattcagaagaacagaccaacaccttaa

SEQ ID NO: 15268 - protein, 245 aa, Glycine max
MSAAVSSTTPHLEEELKNKATNNKKKNNVGGESDQPPYNDGANSDVAEETEPEEDDDSKLESNKDLDLGPQFTLKEQLEKDKDDESLRKWKEQLLGSVDMSVVGSECKDPEVKILSLIITSPDKPDLTLPIPFTTDPKKSLFILKEGSKCQMKFTFTVSNNIVSGLKYTNVVWKTGVRVDSRKKMLGTFSPQQEPYTFELEEETIPSGMFVRGTYAARTKFVDDDRKCYLDVNYYFEIQKNRPTP

SEQ ID NO: 15269 - DNA, 708 bp, Glycine max
  CDS (1)..(708)
atggagggtgcaaactggaggataacagatgaagaagcagggccatcctcttcttctgggattgcttcaactaaacaacaaaacccacctgaaacttttcatcataggaaggaggcagaagaagaagaagaaaccgaggaagaggaagaagaagacgtttgtcagcataaaaatatcacctttgttcctggtcctctcctttctctcaaggatcagatcgaaaaagacaaggaggatgagagcctaaggagatggaaagagaagctgttaggatgcatggaaagtgatttggatggtcagatacatcctgaagtgaaattccattccattggaataatctctgaggattttggtgaagttattacttctttatctgtggatgaaagccaaaatggtcatattctgtttactctcagggagggctctcattatcagcttaagctcaaattcagtgttctgcacaacatcgtgtctggcttgacatactgcaacactgtgtggaaaggagggcttcaagttgaccagagcaaaggaatgttgggtacctttgctccccaaaaagaaccatatgtacatgccttaaaagaggacatcactccatctggtgtgcttgcaaggggtgtatactctgctaagattaagtttgaagatgatgacagaaggtgtcacatggaactcaaatattcgttagagataaagaagaggtag

SEQ ID NO: 15270 - protein, 235 aa, Glycine max
MEGANWRITDEEAGPSSSSGIASTKQQNPPETFHHRKEAEEEEETEEEEEEDVCQHKNITFVPGPLLSLKDQIEKDKEDESLRRWKEKLLGCMESDLDGQIHPEVKFHSIGIISEDFGEVITSLSVDESQNGHILFTLREGSHYQLKLKFSVLHNIVSGLTYCNTVWKGGLQVDQSKGMLGTFAPQKEPYVHALKEDITPSGVLARGVYSAKIKFEDDDRRCHMELKYSLEIKKR

SEQ ID NO: 15271 - DNA, 732 bp, Glycine max
  CDS (1)..(732)
atgtctgctgctgtgtcctccacaacctctcatttagaggaagagcttaaaaacaacaacaacaacaacaacaacgttggtggagaatcagaccagcccccttacaatgagggtgccaactctgatgttgctgaagaaactgagccagaggaagatgatgactccaagttggaatctaacaaagaactggatcttggccctcaattcaccctcaaggaacagcttgagaaagataaagatgatgtaagtttgagaaaatggaaggagcaacttctgggaagtgttgacatgtctgtcgttggaagtgaaagcaaagaccctgaagtaaagatattgagcctcattattacaagcccagacaagcctgacctcacccttccaattccatttactactgatgctaagaagagtcttttcatccttaaggaaggaagcaaatgccaaatgaaattcaccttcactgtctccaacaacatcgtttctggtctcaaatacacaaatgttgtttggaaaactggcgttagagtggacagcagaaaaaagatgttgggaacttttagtcccaagcaggaaccatatacatttgaattggaagaagaaactatcccttctggcatgttcgtcaggggaacctatgcagcaagaaccaagtttgtagatgacgatcgaaaatgctacttggatgtcagttactactttgaaattcagaagaacagaccaacacctcaatga

SEQ ID NO: 15272 - protein, 243 aa, Glycine max
MSAAVSSTTSHLEEELKNNNNNNNNVGGESDQPPYNEGANSDVAEETEPEEDDDSKLESNKELDLGPQFTLKEQLEKDKDDVSLRKWKEQLLGSVDMSVVGSESKDPEVKILSLIITSPDKPDLTLPIPFTTDAKKSLFILKEGSKCQMKFTFTVSNNIVSGLKYTNVVWKTGVRVDSRKKMLGTFSPKQEPYTFELEEETIPSGMFVRGTYAARTKFVDDDRKCYLDVSYYFEIQKNRPTPQ

SEQ ID NO: 15273 - DNA, 1205 bp, Glycine max
  CDS (308)..(1009)
gttgtactaattacaactagtcgtgcatcacccacagtttttcctttttcgagagaaagtgacaaaagagaacaacacatgtctgaacagaaaaagagaggaggttacctacttaagcatcctaaatgacttgggtgagtcaacctttgcaagtgagaaagacgaaacactcaaacagggtgctgctatgagtcctctccctactactaatactctgctgggtcccactctatatgtctctttgaataatgagccaaaattccacacacaaacaaacagataacataacagaagaagaactcaagagatggagagtggcggtaatgggaagagagcacatgaagaagcggggccttcatctgggattgatggaaggaaacttgaaatgactgaaaaagcgagtgatgatgataaagaagaggaggaggaggaggaggaggaggaagaaggagccattgaagatagcaaaaatggtttttttgttcctgggcctcttctttctctcaaggaacagatcgaacgggacaaggaggacgaaagcctaaggagatggaaagagaagctgttgggttgcttggaaagtgatatagatggtcaattggatcctgaagtgaaatttcactccataggaattctctctgaggattttggtgaaattgtcactcctctacctgtggatgaaaatcgcaatggctgtactctatttactctcagggaggggtctcgctatcagcttaagctaaaatttagtgttctgcacaacattgtgtctggcttgacatactccaacactgtgtggaaaggagggcttcaagttgatcagagcaaaggaatgttgggtgcttttgctcctcaaaaggagccatatgtatacgccttgaaggaggacaccactccttccggtgcacttgcaaggggtgtttactcagccaaacttaagtttgaagatgatgacagaaggtgtcacatggaactcaaatatttattcgagataaaaaagagaagctagtccggtttttctgacaccatgtttttatatatcctcccaaaatccttaattatatttctgaacatgtgttatggatgctacagctttgtatttgtttcctaatacacagaaaggggatggactccgttatgaaaaaaaaaaaaaaaaaaaaaaaaaaaaaaaaaaaaaaaaaaaaaaaaaaaaaaaaaaaaaaaaa

SEQ ID NO: 15274 - protein, 233 aa, Glycine max
MESGGNGKRAHEEAGPSSGIDGRKLEMTEKASDDDKEEEEEEEEEEEGAIEDSKNGFFVPGPLLSLKEQIERDKEDESLRRWKEKLLGCLESDIDGQLDPEVKFHSIGILSEDFGEIVTPLPVDENRNGCTLFTLREGSRYQLKLKFSVLHNIVSGLTYSNTVWKGGLQVDQSKGMLGAFAPQKEPYVYALKEDTTPSGALARGVYSAKLKFEDDDRRCHMELKYLFEIKKRS

SEQ ID NO: 15275 - DNA, 723 bp, Glycine max
  CDS (1)..(723)
atgggttttgatgagaaagtgaaagacaatgatggtgcaggggatgatgatgcctctcatcgggtgcacgcggcaaaagctggtacggatcatgaaagtggacatgaaggaggagggaccttcagcagatacaggagtgagagttccattgctgctaccgaggatgaagatgatgaggaggagaggaagattgaattaggtcctcagtgcactttaaaggaacaactcgagaaggataaggatgatgagagcttgaggaggtggaaggagcagcttcttggaagtgttgacataaattctgttggagaaactctggagccaaatgtgaagatccttagccttgcaattaagtctgctgatagacctgacattgttcttgcaataccagagggaggaaatcccaagggcttatggtttactttgaaagagggtagtcgttataggctaatgttcactttccaggttgagaataacatagtttcaggtctcaaatacaccaacactgtgtggaaaactggtgtcaaagttgacagcagtaaagaaatgatcggaaccttcagcccccaagcagagccttacacacatgagatgcctgaagagaccacaccatctgggatgtttgctagaggacaatattcagcaagaagtaagtttgttgatgatgacaacaagtgctacttagagattaactacacttttgatatccgaaaggaatggcagtag

SEQ ID NO: 15276 - protein, 240 aa, Glycine max
MGFDEKVKDNDGAGDDDASHRVHAAKAGTDHESGHEGGGTFSRYRSESSIAATEDEDDEEERKIELGPQCTLKEQLEKDKDDESLRRWKEQLLGSVDINSVGETLEPNVKILSLAIKSADRPDIVLAIPEGGNPKGLWFTLKEGSRYRLMFTFQVENNIVSGLKYTNTVWKTGVKVDSSKEMIGTFSPQAEPYTHEMPEETTPSGMFARGQYSARSKFVDDDNKCYLEINYTFDIRKEWQ

SEQ ID NO: 15277 - DNA, 714 bp, Glycine max
  CDS (1)..(714)
atgggttttgatgacaaattgaaagacaatgagggtgcaggggatgatgatgcctctcgggtgcacgcgggaaaagctggaggaggaggaggaggaggaggagggaccctcagcagatacaggagtgagagttccattgctgctaccgaggatgaagatgatgatgatgaggagaggaagattgaattaggccctcagtacactttaaaggaacaactcgagaaggataaggatgatgagagcttgaggaggtggaaggagcagcttcttggaagtgttgacataaattctgttggagaaactctggagccaaatgtgaagatccttagccttgcaattaagtctgctgatagacctgacattgttcttgcaataccagagggaggaaatcccaagggtttatggtttactttgaaagagggtagtcgttataggctaatgttcactttccaggttgagaataacatagtttcaggtctcaaatacaccaacactgtgtggaaaactggtatcaaagttgacagcagtaaagaaatgattggaaccttcagccctcaagcagaaccttacacacatgagatgcctgaagagacaacaccatctgggatgtttgctagaggacaatattcagcaagaagtaagtttgttgatgatgacaacaagtgctacttagagattaactacacttttgatattcgaaaggaatggcagtag

SEQ ID NO: 15278 - protein, 237 aa, Glycine max
MGFDDKLKDNEGAGDDDASRVHAGKAGGGGGGGGGTLSRYRSESSIAATEDEDDDDEERKIELGPQYTLKEQLEKDKDDESLRRWKEQLLGSVDINSVGETLEPNVKILSLAIKSADRPDIVLAIPEGGNPKGLWFTLKEGSRYRLMFTFQVENNIVSGLKYTNTVWKTGIKVDSSKEMIGTFSPQAEPYTHEMPEETTPSGMFARGQYSARSKFVDDDNKCYLEINYTFDIRKEWQ

SEQ ID NO: 15279 - DNA, 603 bp, Culex pipiens quinquefasciatus
  CDS (1)..(603)
atgtccgccgagaatgaggtcgttccgccggttgagggcgaggaggagcacgatgccaactaccagccacccccgcagaagaccatcgaggagatcatggccgcggacgccgaggacgaaagcttacgaaagtacaaggaagccctgctcggcgaggcccagtccgagaagataatcttcgacgactccgaccctcgcaaggtgattgtgaaaaagctttccctgctcgtcgcggaccgtgacccgatggagctcgacctgtccggagacatttcgaagctgaaaaagaatgtctttgtcatcaaggaaggcattcagtacaagatccgtatcgatttcgtcgtccagcgggaaattgtccacggtttgaagtacatccagaaaacctaccgaatgggagtacccgtggacaaaatgacgcagatggtcggctcgtacccgcccaagaaggaaatccaaagctacacgaccccgttcgaggaggccccgtccgggatgatggcgcgcggcacctactccgtgtcctcgctgttcaccgacgacgacaagaacgagcacctcaagtgggagtggagctttgagatcaaaaaagactggcagtaa

SEQ ID NO: 15280 - protein, 200 aa, Culex pipiens quinquefasciatus
MSAENEVVPPVEGEEEHDANYQPPPQKTIEEIMAADAEDESLRKYKEALLGEAQSEKIIFDDSDPRKVIVKKLSLLVADRDPMELDLSGDISKLKKNVFVIKEGIQYKIRIDFVVQREIVHGLKYIQKTYRMGVPVDKMTQMVGSYPPKKEIQSYTTPFEEAPSGMMARGTYSVSSLFTDDDKNEHLKWEWSFEIKKDWQ

SEQ ID NO: 15281 - DNA, 672 bp, Arabidopsis thaliana
  CDS (1)..(672)
atggttttgaacgatgaggagatgaaagctggagagtcttcagaagagccaaagggacaagggctaagcaggaaaaatagccatagctctatgtgtccgacagatgatgatgaagaagaagaagacaagaaactcgaacttggtcccatgattgctcttaaagaacagctcgagaaagacaaggatgatgaaagcttgaggagatggaaggagcaacttctaggcagcgtggatcttgaggaggtcggagagactccggatccactggtaaagatactaaccttaacaattaggtcaccggatagagaagacatggtattaacgatccctgaaaacggaaaaccggcttcgaaaggaccatggttcactctcaaagaaggctctaagtacactctcatatttactttccgtgtcaccaacaacattgtgtccggcctccaatacagcaatacagtttggaagaccggaatcaaggtgtatagtagaaaggagatgttaggaacgtttagtccacaggcggaaccgtacactcatgttatgtttgaagagacggcaccctctggtctactcgttagaggctcttattctgttaaatctaagttcgtcgatgatgataatcagtgctacttggagaacaactacaccttcgacattcgcaaaaattggctgtga

SEQ ID NO: 15282 - protein, 223 aa, Arabidopsis thaliana
MVLNDEEMKAGESSEEPKGQGLSRKNSHSSMCPTDDDEEEEDKKLELGPMIALKEQLEKDKDDESLRRWKEQLLGSVDLEEVGETPDPLVKILTLTIRSPDREDMVLTIPENGKPASKGPWFTLKEGSKYTLIFTFRVTNNIVSGLQYSNTVWKTGIKVYSRKEMLGTFSPQAEPYTHVMFEETAPSGLLVRGSYSVKSKFVDDDNQCYLENNYTFDIRKNWL

SEQ ID NO: 15283 - DNA, 672 bp, Arabidopsis thaliana
  CDS (1)..(672)
atggttttggaagatgagatgaagaaaggtgaagcgtcaggagagacatcagagaaaatggggttaagcagaaagaacagtgggagctctttgtctccgacagaggatgatgaagaagatgaagacaagaagctcgaactcggtcccatgatcgctctcaaagaacaactcgagagagacaaggatgatgaaagcctgaggagatggaaggaacagcttcttggcgtcgtggatttggaggatgtcggagaaacaccggatccagtagtaaagatactagatctcacaattagatcaccagacagagaggaaatggtattgacaatacccgaagatgggttgccaaacccgaaaggcccttggtttacgataaaggaaggttctaaatacacacttgtcttcaacttccgtgtcacaaacaatatcgtttcgggccttcgctataacaataccgtgtggaaaaccggtgttaaagtggatagtacaaaagcaatgcttgggacgtttagtcctcaagctgagtcttaccaacatgtaatgcctgaagaaatgacaccgtctggtatgtttgctagaggatcctattccgcaagaactaagttcatcgatgacgataacaaatgctacttggagatcaactacaccttcgacatccgcaagagttggcaatga

SEQ ID NO: 15284 - protein, 223 aa, Arabidopsis thaliana
MVLEDEMKKGEASGETSEKMGLSRKNSGSSLSPTEDDEEDEDKKLELGPMIALKEQLERDKDDESLRRWKEQLLGVVDLEDVGETPDPVVKILDLTIRSPDREEMVLTIPEDGLPNPKGPWFTIKEGSKYTLVFNFRVTNNIVSGLRYNNTVWKTGVKVDSTKAMLGTFSPQAESYQHVMPEEMTPSGMFARGSYSARTKFIDDDNKCYLEINYTFDIRKSWQ

SEQ ID NO: 15285 - DNA, 606 bp, Drosophila melanogaster
  CDS (1)..(606)
atggccgaaacagagacgaagcaccatcccgagcaccacgacgacgatgtccacgatgccaactaccaggcgccgccggagaagaccatcgaggaaataatggccgccgatcaggaggatgagagcttgcggcgctacaaggaggcgctcctgggtgccgcccagaccgagaaaattattgttgaacccaatgatccccgaaaagttattgtaaagaaactggccctcgttgtcgaaggacgcgacgacatggaattggatcttaccggtgaccttagtcagctgaaaaagcagctttttgtgatcaaagaaggtgttcagtacaaggtgcgcattgattttattgtgcagcgtgaaatagtccatggccttaagtatgttcaaaagacttctcgcttgggtgttaatgttgacaagatgaagcatatggttggctcctatccgccgaagaaggagattcagttctatttgacgcccgccgaggaggcaccttcaggcacattctcccgcggcacctactcggtcagttcggtcttcacggatgacgacaagcacatacacctggagtgggactggacctttgagatcaaaaaggactgggcctaa

SEQ ID NO: 15286 - protein, 201 aa, Drosophila melanogaster
MAETETKHHPEHHDDDVHDANYQAPPEKTIEEIMAADQEDESLRRYKEALLGAAQTEKIIVEPNDPRKVIVKKLALVVEGRDDMELDLTGDLSQLKKQLFVIKEGVQYKVRIDFIVQREIVHGLKYVQKTSRLGVNVDKMKHMVGSYPPKKEIQFYLTPAEEAPSGTFSRGTYSVSSVFTDDDKHIHLEWDWTFEIKKDWA

SEQ ID NO: 15287 - DNA, 618 bp, Nasonia vitripennis
  CDS (1)..(618)
atgtctgctccaactctggatcatgtcgactcagtggacgaggatttggaagtagagtcaaattacaagccaccaccagagaagagcatcgagcaaattcttgaggctgacaaggaggatgaaagtctgagaaagtacaaggaaactctgctaggagaggcaaaagctggtggtgtagttgttgagcccaatgacccaaggaaagtcatcgttaagaagcttgcactgtgtgtcacagatagacctgatatggagctagatttgacggatttgacgggtgatttgacacagctgaagaaacaaacatttgttattaaagaaggagtcagttacaaaattcgtattgattttattgtacaacgagaaattgtccatggtttgaagtatgtgcagaagacttaccgcttgggtgtaccagtcgataaaatgacgcacatggttggctcatatcctccgaaaaaggagatccagtcttacacgactcctgccgaagatgcgccggccggtgtgatggctcggggctcttacaccgtcagttccctgtttaccgacgacgacaaaaacgaacatcttaagtgggagtggtcgttcgacatcaagaaggactggaaagaataa

SEQ ID NO: 15288 - protein, 205 aa, Nasonia vitripennis
MSAPTLDHVDSVDEDLEVESNYKPPPEKSIEQILEADKEDESLRKYKETLLGEAKAGGVVVEPNDPRKVIVKKLALCVTDRPDMELDLTDLTGDLTQLKKQTFVIKEGVSYKIRIDFIVQREIVHGLKYVQKTYRLGVPVDKMTHMVGSYPPKKEIQSYTTPAEDAPAGVMARGSYTVSSLFTDDDKNEHLKWEWSFDIKKDWKE

SEQ ID NO: 15289 - DNA, 603 bp, Aedes aegypti
  CDS (1)..(603)
atgtctgaaaagcaagccgctgatcatgtcgaagttgagggggaggaacacgacgccaactaccagcctccgccgcagaagaccatcgaggaaatcatggcagccgacgcagaggacgaaagcttacgaaagtacaaagaagccctactgggggaagctcaatcggagaaaattatcttcgatgattccgatccacggaaggttatagtgaaaaagctggcgcttctggtggcggaccgtgatcccatggaactggacctgtccggtgatatttctaagctgaaaaagaatgttttcgtgattaaggaaggcatccagtacaaaatccgtatcgatttcattgtgcagagggaaatcgttcacgggctgaagtatgtccaaaagacatacaggatgggagttcccgtggacaaaatgacccaaatggtcggttcgtacccgcccaagaaagaaattcaaagctacaccaccccattcgaggaggccccctccggcatgatggcacggggcacctactcggtgacgtcccttttcaccgacgatgacaaaaacgaacacctcaagtgggaatggagttttgagatcaaaaaagactggcagtag

SEQ ID NO: 15290 - protein, 200 aa, Aedes aegypti
MSEKQAADHVEVEGEEHDANYQPPPQKTIEEIMAADAEDESLRKYKEALLGEAQSEKIIFDDSDPRKVIVKKLALLVADRDPMELDLSGDISKLKKNVFVIKEGIQYKIRIDFIVQREIVHGLKYVQKTYRMGVPVDKMTQMVGSYPPKKEIQSYTTPFEEAPSGMMARGTYSVTSLFTDDDKNEHLKWEWSFEIKKDWQ

SEQ ID NO: 15291 - DNA, 594 bp, Physcomitrella patens subsp. patens
  CDS (1)..(594)
atggaatccgacgacgacgagtcgcaagcagatcaagaggggccgtgtgtgaaatttaacgagaaggagctgggcccgttggtgtcgttgaaggagcagctggaaaaggacaaggaggacgagagtctgaggcgatggaaggcgcagctgctgggggtggcgagtgaggatgcgccagacggttttgtggagccggaggtgaacgtgctgtcgctgggagtgattgcgaagggacgaccggacagcgagttgccgctgccgctggggacgaactcgcgggggtacacgttctcgctgaaggaggggtcgacggtggcgctgaggtactcgttcactgtgcgtaacaacatcgtgtccgggttgacgtgcatgaacacggtgtggaaggcggggctacaggtggatcagacacgggacatgatggggactttcgcgccacagcaggaggcgtacgtgcacgtgacggaggaggaggtgacgccttcggggccgctggcccgcggcgcttacacggcgcggaagaggttcatcgacgacgacggaagggtgcacctggacttggagtactcgttcgagatccggaaggagtggtag

SEQ ID NO: 15292 - protein, 197 aa, Physcomitrella patens subsp. patens
MESDDDESQADQEGPCVKFNEKELGPLVSLKEQLEKDKEDESLRRWKAQLLGVASEDAPDGFVEPEVNVLSLGVIAKGRPDSELPLPLGTNSRGYTFSLKEGSTVALRYSFTVRNNIVSGLTCMNTVWKAGLQVDQTRDMMGTFAPQQEAYVHVTEEEVTPSGPLARGAYTARKRFIDDDGRVHLDLEYSFEIRKEW

SEQ ID NO: 15293 - DNA, 711 bp, Physcomitrella patens subsp. patens
  CDS (1)..(711)
atgaacaagcaagacgcgcagacggcagagcaagggaacgaggagaaggagaatgggagcgagaaggaggtgaagtgcctgacgaagtgcgagtcgcttccgacgaactcgagcagcgtggagtcggacgacgacgagtcgcaggcagagcaggaggcagcgtgtgcagcgttcaacgagaaggagctgggtccactggtgtcgttgaaagagcagctggagaaggacaaggaagacgagagcctgcggcgatggaaggcgcagctgctgggggtggcaagcctggaggagggggacgggttcgtggagccggaggtgaaggtggtgtcgctgggggtgatggcgaaggggcgagcggacagcgagtttccgctgccgctggggacgaacagcaggggttacacgttttcgctgaaggaggggtcgacggtggcgctgaagtacgtgttcacggtgcggaacaacatcgtgtcggggctgacgtgcgtgaacacggtgtggaaggtggggctgcaggtggaccagacgcgggacatgatggggacgttcgcgccgcagcaagaggcgtacgtgcacatcgcggaggaggaagtgacgccgtgcgggcctctggcgcgcggggcatacacggcgcggaagaagttcgtggacgacgacgggagggtgtacctggagttggattactcgttcgagattcggaaggagtggtag

SEQ ID NO: 15294 - protein, 236 aa, Physcomitrella patens subsp. patens
MNKQDAQTAEQGNEEKENGSEKEVKCLTKCESLPTNSSSVESDDDESQAEQEAACAAFNEKELGPLVSLKEQLEKDKEDESLRRWKAQLLGVASLEEGDGFVEPEVKVVSLGVMAKGRADSEFPLPLGTNSRGYTFSLKEGSTVALKYVFTVRNNIVSGLTCVNTVWKVGLQVDQTRDMMGTFAPQQEAYVHIAEEEVTPCGPLARGAYTARKKFVDDDGRVYLELDYSFEIRKEW

SEQ ID NO: 15295 - DNA, 603 bp, Anopheles gambiae str. PEST
  CDS (1)..(603)
atgtcgaccgaaaaggaaatgaatcccgcggaggtggagcaggaggaacacgacagcaactatcagccaccgccgcagaaaacgatcgaggaaattatggccgccgatgcggaggacgaaagcttgcgaaagtacaaggaggcactgctcggcgaggcacaggcggaaaagattatctttgatgaatccgatccgcggaaggtgatcgtgaaaaagcttgccctgctggtggccgatcgtgatccgatggagctcgatttgactggcgatttaacgaagctgaaaaagaatgtgttcgtcattaaggaaggcattcagtacaaaattcgcatcgatttcgtagtgcagcgggagattgtgcacggtttgaagtatgtgcagaaaacctaccgaatgggcgtcccagtcgataaaatggtccagatggttggttcctatccaccaaagaaggaaatccagagctacaccaccccgttcgaggaggccccgtccggcatgatggcccgcggtacctactccgtcacctccctcttcaccgacgacgacaagaacgagcacctgaagtgggactggagttttgagattaaaaaagactggcagtaa

SEQ ID NO: 15296 - protein, 200 aa, Anopheles gambiae str. PEST
MSTEKEMNPAEVEQEEHDSNYQPPPQKTIEEIMAADAEDESLRKYKEALLGEAQAEKIIFDESDPRKVIVKKLALLVADRDPMELDLTGDLTKLKKNVFVIKEGIQYKIRIDFVVQREIVHGLKYVQKTYRMGVPVDKMVQMVGSYPPKKEIQSYTTPFEEAPSGMMARGTYSVTSLFTDDDKNEHLKWDWSFEIKKDWQ

SEQ ID NO: 15297 - DNA, 597 bp, Gibberella zeae PH-1
  CDS (1)..(597)
atggcttcccacgacgatgataccatgcccgaggagactcagggctacaagctctctcagcccaagcagagtctggctgagtaccagcagatggacgctggcgatgagtctctccagcgatacaaggagtcccttggtctcggaggtggtaccgacatctctgaccccaacgacccccgagtctgcatcattctctccttgaccatggactcccccggccgtcctcccgtcaccatcgatctctctacccctggaagcgagaccaccctcaaggacaagcccttcaacatcaaggagggtgccaagttcaccatgagcgccaagttcaaggttcagcacgagattctcagcggccttcactacgttcaggttgttaagcgaaagggtatccgcgtctccaaggactccgagatgattggcagctacgctcccagcaccgacaagcagcccacttatatcaagaagttccaagaggaggaggcccccagcggcatgctcgctcgtggccactacaacgccatctctagcttcgttgacgacgataagaagaagcatctcgagtttgaatggagtttcgatattgccaaggactggtag

SEQ ID NO: 15298 - protein, 198 aa, Gibberella zeae PH-1
MASHDDDTMPEETQGYKLSQPKQSLAEYQQMDAGDESLQRYKESLGLGGGTDISDPNDPRVCIILSLTMDSPGRPPVTIDLSTPGSETTLKDKPFNIKEGAKFTMSAKFKVQHEILSGLHYVQVVKRKGIRVSKDSEMIGSYAPSTDKQPTYIKKFQEEEAPSGMLARGHYNAISSFVDDDKKKHLEFEWSFDIAKDW

SEQ ID NO: 15299 - DNA, 618 bp, Apis mellifera
  CDS (1)..(618)
atgtcagaacttaatactgatcacgttgactctgtagaagaagaattggaagtggaatctaactacaaacctccaccagaaaaaacaatagaacaaattttagaaacagataaagaagatgaaagtttacgtaaatataaagaaacacttttgggagaagccaaatctggaggtattgttgtagatccaaatgatcctaggaaagtaatagtaaagaaattagcactttgtgtagcagatcgaccagatatggaattagatttaacaggtgatctatctcaattaaaaaaacaaacatttgtaataaaagaaggtgtcagctatagaattagaattgatttcatcgttcaacgtgaaattgtgcatggtttaaaatatgttcaaaaaacttatcgttttggagtaccaggtgttacagtggataagatgatgcatatggtgggttcttatccaccaaaaacagaaattcaatcatatactactccaacagaggatgcaccagctggaaaagtggcacgtggttcttatagtgtaagctccttgtttactgatgatgacaaacatgaacatcttaagtgggagtggtcatttgaaattaagaaagactggaaagaataa

SEQ ID NO: 15300 - protein, 205 aa, Apis mellifera
MSELNTDHVDSVEEELEVESNYKPPPEKTIEQILETDKEDESLRKYKETLLGEAKSGGIVVDPNDPRKVIVKKLALCVADRPDMELDLTGDLSQLKKQTFVIKEGVSYRIRIDFIVQREIVHGLKYVQKTYRFGVPGVTVDKMMHMVGSYPPKTEIQSYTTPTEDAPAGKVARGSYSVSSLFTDDDKHEHLKWEWSFEIKKDWKE

SEQ ID NO: 15301 - DNA, 603 bp, Candida glabrata CBS 138
  CDS (1)..(603)
atgagtgaaccagatttcaacgattttgaagagagtactaatgatgacaagtacaaggtctctgagaagaagactgttgatgaatacaagaagttagatgctgaggatgagtccctggctaaatggaaggaatctttgggactgtcctctgatgttctgccattggagtttcctggcgacaccagaaaagttgtgatacaaaagattcaattgttggtggatacagagaaagagccaattacatttgatttgaccaatgagacaacgataaaagaactggcctcgaagcgttacaaagttaaggaaaagtccatttataagttacgtatcacttttaaagtccagcatgaaatcattacagggcttagatatgttcagtatattaagaaggcagggatcgcggtggataaaattgatgatcatttaggatcatatgccccaaacacaaaacaaaagcctttctatgaagtggaattgcctgaaagcgaggccccaagtgggttcttggctagaggtaactacagtgccgtctctaaatttattgatgatgacaaaacaactcatctaactttgaactggggtgtcgaaattgtgaagaaatag

SEQ ID NO: 15302 - protein, 200 aa, Candida glabrata CBS 138
MSEPDFNDFEESTNDDKYKVSEKKTVDEYKKLDAEDESLAKWKESLGLSSDVLPLEFPGDTRKVVIQKIQLLVDTEKEPITFDLTNETTIKELASKRYKVKEKSIYKLRITFKVQHEIITGLRYVQYIKKAGIAVDKIDDHLGSYAPNTKQKPFYEVELPESEAPSGFLARGNYSAVSKFIDDDKTTHLTLNWGVEIVKK

SEQ ID NO: 15303 - DNA, 600 bp, Kluyveromyces lactis NRRL Y-1140
  CDS (1)..(600)
atgtctgaagaagaggagtttaaacaattcgatgaagaaaacgatacatacaaagtcggggagaagaagactgtagaagaatacaaaaacttagatgctgatgatgaggcgttaagaaaatggaaagattctttaggattgggaggtgatgttttaccattggaacatcctggggatgaacgtcgtgtggtgatccagaagattcagttgatcgttgacacagaaccagcgccaattacgtttgatttgacaaacgagaagactttgaaagacctggcctcaaagagatacaagatcaaagaaaaatctatttaccatttgaagatcactttcaaggttcaacacgaaattattactggcttaagatacgtgcaatacaccaaaaaggcaggcattgcagttgataagattgatgaccacttgggttcgtatgctccaaataccacaaagaacccattttatgaggtggaattgcctgaatctgaagcgccaagtggtttccttgttcgcgggaattattctgcagtctcaaagttcatagatgatgataagaacaaccatttgactttgaattggggtgttgaaattgtgaaaaggtga

SEQ ID NO: 15304 - protein, 199 aa, Kluyveromyces lactis NRRL Y-1140
MSEEEEFKQFDEENDTYKVGEKKTVEEYKNLDADDEALRKWKDSLGLGGDVLPLEHPGDERRVVIQKIQLIVDTEPAPITFDLTNEKTLKDLASKRYKIKEKSIYHLKITFKVQHEIITGLRYVQYTKKAGIAVDKIDDHLGSYAPNTTKNPFYEVELPESEAPSGFLVRGNYSAVSKFIDDDKNNHLTLNWGVEIVKR

SEQ ID NO: 15305 - DNA, 624 bp, Debaryomyces hansenii CBS767
  CDS (1)..(624)
atggcgtcaaataacccagaagctcttcaagatgatgaattgattcctgaatccgttgaaggataccacgttggagaaaaaaagaccatcgaagaatatacgaagttagatgctgaagatgaaagtttagctaaatggaaggcttcgcttggattatcagataatagtaacgcttatccagtcaaagcaggcgataagcgtaaggttgttatcgttgaaatgtcattgcaatttccaaatcaaccagagttacaacccattgtgatagatttagaagatgcacaaggtaacacgatagccggtaaagaaatcaagttcagtattaaggaaaaatctgtttaccagttcgttatcaaattccgtgtgcagcatgaaattattactggcttaaagtacttacacctgattaagaaaacaggtatcagggttgataagttagaagaaccattagggtcgtatgctccaaatactaaagaaaagccatattatgagaaagtattcagcgaggtggaggcaccttctggtatgttggcaagaggcggctattctgccactacaaagtttgttgatgacgataaaaatgttcatttgtcattcccatggagtttccaaattacgaagtga

SEQ ID NO: 15306 - protein, 207 aa, Debaryomyces hansenii CBS767
MASNNPEALQDDELIPESVEGYHVGEKKTIEEYTKLDAEDESLAKWKASLGLSDNSNAYPVKAGDKRKVVIVEMSLQFPNQPELQPIVIDLEDAQGNTIAGKEIKFSIKEKSVYQFVIKFRVQHEIITGLKYLHLIKKTGIRVDKLEEPLGSYAPNTKEKPYYEKVFSEVEAPSGMLARGGYSATTKFVDDDKNVHLSFPWSFQITK

SEQ ID NO: 15307 - DNA, 609 bp, Yarrowia lipolytica CLIB122
  CDS (1)..(609)
atgtctcagcagcagcatctggaagaggaggaggaagaggaatttgttgacacctatgtgcctggcgagaagaagtccgtggcggagtacgtgaacctggacgctgaggacgagtctctgcgaaagtggaaggaggctcttggaatcacctccaacgtggcaggccagacggtgggtgatcctaacgacaagcgaagggtcgtgatcatggagaacagaacctatcttggtgatgacgagcccatcgtcaagaacctggaagatcccaagaccatcgaggatctcaagactggaacaatcaagatcaaggagaagatcaagtactactctgagatcaaattccgagtccagcatgagattgttaccggtctggtctaccagcagactatctctcgaatgggagtgcctatcgagacccgaaagcaggtgatgggctcataccctcccaacacccccgagaaccccttctatgtcaagaagtttgagctgcaggaggcaccctcgggatttctggtgcgaggaaagtaccttggccagtcaaagtacattgatgacgacggtgtcgttcatgccgagtaccctttcaactttgagatcaccaagaaatag

SEQ ID NO: 15308 - protein, 202 aa, Yarrowia lipolytica CLIB122
MSQQQHLEEEEEEEFVDTYVPGEKKSVAEYVNLDAEDESLRKWKEALGITSNVAGQTVGDPNDKRRVVIMENRTYLGDDEPIVKNLEDPKTIEDLKTGTIKIKEKIKYYSEIKFRVQHEIVTGLVYQQTISRMGVPIETRKQVMGSYPPNTPENPFYVKKFELQEAPSGFLVRGKYLGQSKYIDDDGVVHAEYPFNFEITKK

SEQ ID NO: 15309 - DNA, 594 bp, Aspergillus nidulans FGSC A4
  CDS (1)..(594)
atggccgaacatgacgacgaactcattgcctccaagactgaaggcttcaaggtcggagagaagaagacaattgctgaatacaatgagctcgacaaaaatgacgaatccctcaaccgttggaaggcctccctcggcctaaacaccggcgagcccaccggagaccccaacgacccccgaacatgtatcatcaaaaccctagcgcttgaagttcaaggccgtccggatgttgttatcgatgtctctgccccgggcgcgctcgagaagctgaaggacaagcccttcactatcaaggagggcgcccacttccgcattaaggtgacctttgaggtccaccacgatgttctgagcggcctcaagtacctccaggttgtcaagcgcaagggtatccgggttagcaaggatcaggagatgcttggaagttatgcgccatgcactacaggaaagccaatttacgagaagaagttccaagaagaggaggccccctcggggatgatggctcgcggccactacaacgcggaatcgaagtttatcgacgacgatgacaaagtgcatctccacttccactggtccttcgacattgcgaaggactggtaa

SEQ ID NO: 15310 - protein, 197 aa, Aspergillus nidulans FGSC A4
MAEHDDELIASKTEGFKVGEKKTIAEYNELDKNDESLNRWKASLGLNTGEPTGDPNDPRTCIIKTLALEVQGRPDVVIDVSAPGALEKLKDKPFTIKEGAHFRIKVTFEVHHDVLSGLKYLQVVKRKGIRVSKDQEMLGSYAPCTTGKPIYEKKFQEEEAPSGMMARGHYNAESKFIDDDDKVHLHFHWSFDIAKDW

SEQ ID NO: 15311 - DNA, 612 bp, Candida albicans SC5314
  CDS (1)..(612): transl_table=12
atgtccaattctaacgttgatgatgatttagttcctgaaaaagttgaaggatacactgttggtgaaaagaaaaccattgatgaatacaaaaacttggatgctgaagatgaaagtttggctaaatggaaagcatcattagggttaactgctgacactaaaccatacccagttaaaccaggtgacaagagaaaagttgttgttactgaattggcattggaattccctgaacaaccagatttacaaccaattagaatcaatttagaagatagtgatggaaacaccatcgttgataaagaaataaaattcaacattaaagaaaaatcaatttatcaattggtggttaaatttagagttcaacatgaaatcatcactggattgaaatatttacatctggtcaaacgtggtggtataagagttgaaaaagttgaagaaccattaggttcttatgctccaaacactattgataaaccattttatgaaagaaaatttgctgaagttgaagcaccaagtggtatgattgctagaggtacctatagtgccatcagtaaattcattgatgacgatgataatgtgcatttaacagttccttggagtttttccattactaaatag

SEQ ID NO: 15312 - protein, 203 aa, Candida albicans SC5314
MSNSNVDDDLVPEKVEGYTVGEKKTIDEYKNLDAEDESLAKWKASLGLTADTKPYPVKPGDKRKVVVTELALEFPEQPDLQPIRINLEDSDGNTIVDKEIKFNIKEKSIYQLVVKFRVQHEIITGLKYLHSVKRGGIRVEKVEEPLGSYAPNTIDKPFYERKFAEVEAPSGMIARGTYSAISKFIDDDDNVHLTVPWSFSITK

SEQ ID NO: 15313 - DNA, 609 bp, Ustilago maydis 521
  CDS (1)..(609)
atgtcgcatgcacaggatcccaccattggcgacgacgagcttgctacaactgccaccgccggctacaaggttggcgagaaaaagtcgctcgctgaatactcgcagctggatgcggaagacgagtcgctagcaagatggaaggcaagcctcggaattggcgcttccaccagcgccgtcgacccaaatgctcctaagctctcactacacagtctctccctagtatcgccaacagcacctggcggaagcatctcgatcaacctccagcagcccaaagagcagcttgcacagatcaagcagaaccccctctcggtcaaggagggcgtcgagtacagtgtcaagattcggttcagcgtgggaagcgacattctctcgggtctcaagtacgttcaggtggtcaagcgggccggcatcaaggtcgacaagatggaagagatgatcggatcctacggtccacgacccgagccatatgaaaagacgtttgcttccagtgaggcacccagcggtatgatggctcgtggcaactacagcgtacgcagtcgtgtggtcgatgacgacaaccacgtttttgccgactgggagtgggctttcaagatcgccaaggactggtaa

SEQ ID NO: 15314 - protein, 202 aa, Ustilago maydis 521
MSHAQDPTIGDDELATTATAGYKVGEKKSLAEYSQLDAEDESLARWKASLGIGASTSAVDPNAPKLSLHSLSLVSPTAPGGSISINLQQPKEQLAQIKQNPLSVKEGVEYSVKIRFSVGSDILSGLKYVQVVKRAGIKVDKMEEMIGSYGPRPEPYEKTFASSEAPSGMMARGNYSVRSRVVDDDNHVFADWEWAFKIAKDW

SEQ ID NO: 15315 - DNA, 627 bp, Cryptococcus neoformans var. neoformans B-3501A
  CDS (1)..(627)
atgtccaaccaacaggtaagcacacacacaccgcgcagcgctgacatgcagcccgaagacgagctcgctcccacccgcacagaaggctacaagctaggccactcaaagactgtcgccgagctcgctgctctcgaccaggacgacgaatctttgcaacgctggaagcagtctcttggtatcgctgcaggggcctctgccggcggtgagaagcgcgtcgttctcaaatcgctcttcctttcatcacctacactccccagccagatcaccatcgacctcacccagtctaaagatgcgcttgcaaagctcaaaaaggatccagtgaccatcaaggagggcgtcgagtactctgtcggcattacctttatgattgaaaacgaaattgtctctggtctcaaatacctccaggtcgttaagcgcagtggaatcactgtcgacaagacggaggccatgcttggatcttacggcccccagccagaaccttttactaaagtatttgcctctgaagagtcgccctctgggatgctggctcgctcaggcacctatgtcgtcaggagccgagtcattgacgatgacaacactatctggcttgatttcgaatggggcttcaagctcggcaaggaatggtaa

SEQ ID NO: 15316 - protein, 208 aa, Cryptococcus neoformans var. neoformans B-3501A
MSNQQVSTHTPRSADMQPEDELAPTRTEGYKLGHSKTVAELAALDQDDESLQRWKQSLGIAAGASAGGEKRVVLKSLFLSSPTLPSQITIDLTQSKDALAKLKKDPVTIKEGVEYSVGITFMIENEIVSGLKYLQVVKRSGITVDKTEAMLGSYGPQPEPFTKVFASEESPSGMLARSGTYVVRSRVIDDDNTIWLDFEWGFKLGKEW

SEQ ID NO: 15317 - DNA, 603 bp, Strongylocentrotus purpuratus
  CDS (1)..(603)
atggctgaagaggcagatcaggaacagatccaggctgtggaggacatcgatgaaccagacgccacaccaggctatcagccgcctgcaaagaaaaccatctccgagatcaacgaactagacaaggatgatgaaagtttagtcaagtacaagcaacagctacttgctggtgccgcggaagtattagatgaaggaggcgcaaacgtattagtaagaaagatgattttccatgttgaaggcagagaagacatagtcctagatttaacaggagacttggcgaaattgaaggagcatcccattacaatcaaggagggaatcgaatatagaatcgtcatagaattcagggttcagcgtgagattgtggctggtctgaggtacttccagactacgtccaggaaaggaatcaaagttgataagtcaagtcttatggttgggagctatggacccaagacagagccgcatttgtaccagacgccaaacgaagaagcaccttctgggatgatttcaagaggtcactacacggtcaagagcaagttcaccgatgatgacaagacttccattctggaatgggattgggccttcgatatcaagaaggactggaagtga

SEQ ID NO: 15318 - protein, 200 aa, Strongylocentrotus purpuratus
MAEEADQEQIQAVEDIDEPDATPGYQPPAKKTISEINELDKDDESLVKYKQQLLAGAAEVLDEGGANVLVRKMIFHVEGREDIVLDLTGDLAKLKEHPITIKEGIEYRIVIEFRVQREIVAGLRYFQTTSRKGIKVDKSSLMVGSYGPKTEPHLYQTPNEEAPSGMISRGHYTVKSKFTDDDKTSILEWDWAFDIKKDWK

SEQ ID NO: 15319 - DNA, 603 bp, Tribolium castaneum
  CDS (1)..(603)
atgtccgaaggcgacgtcacgacccccgacgagttcgagcacgaaaacgagacaaattacaagcccccgcccgaaaaaaccatcgaggagatcctgcaggcggaccaggacgatgaaagtctgcggaagtacaaggagacgctcctggggcaggcccagaccgggcctgtgatcgttgagcctgataacccccgcaaagtcatcgtgaagcggctggttttggtggtggccgataggccggaaatcgcgctggatttgacgggggacttgtcccggttgaagaaagagactttcgtgattaaggagggcgtttcgtacagaatccggatagagtttatcgtccagagggagatcgtgcatgggcttaagtacgtgcaaaagaccagcaaactcggaatgtcagtggacaaaatgacccatatggtcggctcatacgcccccaaaatggaaattcagtcctacaccacaccaccagaggatgcccccacggggatgttagcacgtggttcgtacacagtccactccctgttcaccgacgatgacaaaaacgagcatctcaaatgggagtggagcttcgaaatcaaaaaagattggaaagattaa

SEQ ID NO: 15320 - protein, 200 aa, Tribolium castaneum
MSEGDVTTPDEFEHENETNYKPPPEKTIEEILQADQDDESLRKYKETLLGQAQTGPVIVEPDNPRKVIVKRLVLVVADRPEIALDLTGDLSRLKKETFVIKEGVSYRIRIEFIVQREIVHGLKYVQKTSKLGMSVDKMTHMVGSYAPKMEIQSYTTPPEDAPTGMLARGSYTVHSLFTDDDKNEHLKWEWSFEIKKDWKD

SEQ ID NO: 15321 - DNA, 765 bp, Oryza sativa subsp
  CDS (1)..(765)
atgtcgtcggcggtggatgccatctcctgttccaagggcatcgcggccccgccgacggaggaggcgacgaaggagcgggtggcggtggtgggcaagaacggcggcgtggagcacggcggcgacgccgcgacgatgaacgggaagcagtgcggcgaggcgccgcattgccgcaaggagagcaacgaggaggaggaggatgacgaggagaaggcccccaaggccatcgacctcggcccgcgtgtcagcatcaaggaccagctcgagaaagacaaggacgacgagagcctgaggcggtggaaggagcagctgctcggcagcgtggatttgaactccgtaggagagacgttggagcctgacgtgaagatcatgagcctggccatcctctcgcccggccggccggacatcttcctgccgctgccggtggagcccaacgccaagggcgtctggttcaccctcaaggagggctccctctacaagctcaagttcaccttctccgtcagcaacaacatcgtctccggcctccgctacaccaatgccgtctggaagaccggcatcaaagttgacagccacaaggagatgctcggcacgttcagcccccagccggagccgtacacgtacgtgacgccggaggagaccacgccgtccggcatgtttgcgaggggatcctactcggccaggacgaagttcctcgacgacgaccggaaatgttacctggagatcaactacaccttcgacatacgccgagagtggccggcgttgagctaa

SEQ ID NO: 15322 - protein, 254 aa, Oryza sativa subsp
MSSAVDAISCSKGIAAPPTEEATKERVAVVGKNGGVEHGGDAATMNGKQCGEAPHCRKESNEEEEDDEEKAPKAIDLGPRVSIKDQLEKDKDDESLRRWKEQLLGSVDLNSVGETLEPDVKIMSLAILSPGRPDIFLPLPVEPNAKGVWFTLKEGSLYKLKFTFSVSNNIVSGLRYTNAVWKTGIKVDSHKEMLGTFSPQPEPYTYVTPEETTPSGMFARGSYSARTKFLDDDRKCYLEINYTFDIRREWPALS

SEQ ID NO: 15323 - DNA, 810 bp, Oryza sativa subsp
  CDS (1)..(810)
atgtcttcggcggccggtgaaccctcctcctcctccgccgccgccgccgccatctcttgctcctcctccaacgacgacgagaagccaccgccgtctctggaggggaaggagctgcggcgagtcgcggaagaggagcccgccgccgccgcgcgccccgagaagctcacggaggcgtcctcgcgcgccgctgaggctgaggaggaggaggtggtggaggatgaggaggacgatgacgaggaagatgaggggaaggtggcggaggccatcgacctcggccccagggtcagcatcaaggagcagctcgagatggacaaggaggatgagagccttcggagatggaaggagcagcttcttggcagcgtcgatttgaactcagtcggagagtcactggagccagacgtgaggatcacaagcctgtgcatcctgtcaccggggcggccggacgtccttctgccgctgcccgtggagccgagcaactccaaggaaccatggttcaccctcaaggaaggcagcacgtacaggctcaagttcaccttctctgtcagcagcaacatcgtctctggcctccgctacaccaacaccgtatggaaggccggcatccgagtggacaaaaccaaggagatgcttggcacgttcagccctcagctggagccgtacacttacgtgacgcctgaggagacgaccccctcgggagtatttgctcggggatcatactctgcaaaaacaaagttcgtcgatgatgaccggaagtgctacctggagatcaactacaccttcgacatccgccgggactggccctgcaagtcctga

SEQ ID NO: 15324 - protein, 269 aa, Oryza sativa subsp
MSSAAGEPSSSSAAAAAISCSSSNDDEKPPPSLEGKELRRVAEEEPAAAARPEKLTEASSRAAEAEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 15325 - DNA, 576 bp, Vitis vinifera
  CDS (1)..(576)
atgggggtggaagaggaagaggaagatgaagagaggaagatagagttgggtcctcagttcactctcaaagaacaacttgagaaagataaggatgatgagagcttgaggaggtggaaggaacagcttcttggcagtgtggatttgaattctgttggagaaactctagaaccagatgttaagatcctggaacttgcaataaagtcccctggtagacctgacattgttcttccaatccccgaatcgggaaatcctaagggcttgtggtttactttgaaagaaggcagtcgttacagcatgaacttcgctttcaaagtcagtaataacattgtatcaggcctcagatgcaccaatgttgtttggaaaacaggactcaaggtggacagcacaaaagagatgcttggaaccttcagtcctcagcaggagacttacactcatgagatgcctgaagagacgaccccatctgggatctttgctagaggaacttactcagctaaaaccaagtttcttgatgacgataacaagtgctacttggagatcaactacagcttcgacatcaggaaagattggcagtcatga

SEQ ID NO: 15326 - protein, 191 aa, Vitis vinifera
MGVEEEEEDEERKIELGPQFTLKEQLEKDKDDESLRRWKEQLLGSVDLNSVGETLEPDVKILELAIKSPGRPDIVLPIPESGNPKGLWFTLKEGSRYSMNFAFKVSNNIVSGLRCTNVVWKTGLKVDSTKEMLGTFSPQQETYTHEMPEETTPSGIFARGTYSAKTKFLDDDNKCYLEINYSFDIRKDWQS

SEQ ID NO: 15327 - DNA, 624 bp, Triatoma infestans
  CDS (1)..(624)
atgtctgatagcgggtcgggtgagggtgagcatgaacacattgaatcggcattggaagatctggaaatagaatcatcgtataaaccacctccagaaaagtctattgaagaaattatatcagcggataaggaagatgaaagtttacaaaaatataaggaagcacttttgggtgaagcaaaaggaggcaaaattgttgtggaatccaacgatgagagaaatgtaatagtgaagaggttagctttgtgtgtatcaaaccgacctgatatggaactagatttaacgggaccacttgaccaactcaaaaaacaagtatttgtgataaaagaaggaatttcatacaagattagaattgatttcattgtacaaagagaaattgttcacggtttgaagtacatacagaaaacctacaggctaggagtaccagttgatcgcatgacacatatggttggctcatacccaccaaaaactgaaatgcaatcatatactacaccattagaaggtgccccatcaggagttatggctcgtggatcatatactgtaagttcattatttactgatgatgataaaaacaatcatctgaaatgggaatgggcttttgagataaaaaaagattggaaggactaa

SEQ ID NO: 15328 - protein, 207 aa, Triatoma infestans
MSDSGSGEGEHEHIESALEDLEIESSYKPPPEKSIEEIISADKEDESLQKYKEALLGEAKGGKIVVESNDERNVIVKRLALCVSNRPDMELDLTGPLDQLKKQVFVIKEGISYKIRIDFIVQREIVHGLKYIQKTYRLGVPVDRMTHMVGSYPPKTEMQSYTTPLEGAPSGVMARGSYTVSSLFTDDDKNNHLKWEWAFEIKKDWKD

SEQ ID NO: 15329 - DNA, 687 bp, Vitis vinifera
  CDS (1)..(687)
atggggtttgatgaaaagatggaggctggagacaagagtggagctttggaaacaaaaacatcagaaacaatgtcagcaaatcaagtgggtgttgatgagtcttctcagaatgcagctgaggaggaggaggaagaagtggaaagaaaaataaagttgggtcctcaattcaccctcaaagaacagcttgagaaggacaaggatgatgagagtctgaggaggtggaaggaacagcttcttgggactgtggatttggaaaatgttggagaaactcttgaaccagaagtcaggatccttagtctgtcaatcatctctcctggtagacccgacattgttcttcctatcccagaagatggaaaacccaaggggttatggttcagtttggaagaaggtagtcattacaaattgaaattctccttccaagtgagcaataacattgtatctggcctcagatatacgaacactgtttggaaaaccggtatgaaggtggacagctcaaaggagatgtttggcacctttagtccacaggctgaaccttacacacatgagatgcttgaagaaatcaccccttctggctttttcgctagaggatcatattcagcgcgatcaaagtttcttgacgatgacaacaagtgctacttggagatcaactacacctttgacatccggaaagaatgggcaaccccatga

SEQ ID NO: 15330 - protein, 228 aa, Vitis vinifera
MGFDEKMEAGDKSGALETKTSETMSANQVGVDESSQNAAEEEEEEVERKIKLGPQFTLKEQLEKDKDDESLRRWKEQLLGTVDLENVGETLEPEVRILSLSIISPGRPDIVLPIPEDGKPKGLWFSLEEGSHYKLKFSFQVSNNIVSGLRYTNTVWKTGMKVDSSKEMFGTFSPQAEPYTHEMLEEITPSGFFARGSYSARSKFLDDDNKCYLEINYTFDIRKEWATP

SEQ ID NO: 15331 - DNA, 609 bp, Tuber borchii
  CDS (1)..(609)
atggcttcacacgcagatgacgagcttaagccatccaccaccgaaggatacaaggtgggagaaaagaagtcagttgatgaatacaaaaaattagatgccgaggatgagtctctcaaccgctggaaacggtccctaggtatcggtgctggtagcactggtggctctcttggagaacccggcgatgcgcgaaaggttgttgtcctccaactctgcttattgatcaccggtcgtccagatgttgttatcaacctcgattctcctggagccctagagagcctgagtgggaagccttttactattaaggaaggtgctgagtaccggatgagagtcagattccgggttcagcatgaagttatctctggattgagatatctgcagcttgtgaagaggaaggggatcaaggtcgataagtctgaagaaatgatggggagctacccaccaaatgtctcggaaagcccctactacgagaaaacttttgctgatgaggaagcgccctccggaatgctctaccgtggccactacaacgctctcagcaagtttatggatgacgacgggaataaccacttggagtttaactggagctttgagattaaaaagagctgggattaa

SEQ ID NO: 15332 - protein, 202 aa, Tuber borchii
MASHADDELKPSTTEGYKVGEKKSVDEYKKLDAEDESLNRWKRSLGIGAGSTGGSLGEPGDARKVVVLQLCLLITGRPDVVINLDSPGALESLSGKPFTIKEGAEYRMRVRFRVQHEVISGLRYLQLVKRKGIKVDKSEEMMGSYPPNVSESPYYEKTFADEEAPSGMLYRGHYNALSKFMDDDGNNHLEFNWSFEIKKSWD

SEQ ID NO: 15333 - DNA, 633 bp, Petunia integrifolia subsp
  CDS (1)..(633)
atgtcagctattgttgaaccaatttcaccaaacaaggcccaattgatcattgatcaacaggagaccatgaagatggtgaggagtagtgatggaattgagcaagaagaggaagaaaacaagtgcaacagccccatgaatgaagagaaagataaagatgatgaaaggttgagcaaggaacaacctgggagtgttgatgactctgcagttcgagaggacaaagacgcagaggtacaagaaccaagattatacataatttgccctgacagaccagatttagagctttcagagccattcatttcaactcctaaagcttgcctctttacactcaaggaaggaagtcgttacaagctgaaattttcatttactgtctcaaataacgttgtctctggtctcaaatacatcaatactacatggaaatctggtgtaagagttgataagtctgaagtgatgctgggaacatttagtccacggaaagagccatatgtatatgaattagaggaagatgtcacaccttctggtgtctttgctaggggcttatattcagcaagaacacaggttatagatgagaaaggaacatgctatgtggatatcaagtactactttgatattcagaagcaatggcttcagctctga

SEQ ID NO: 15334 - protein, 210 aa, Petunia integrifolia subsp
MSAIVEPISPNKAQLIIDQQETMKMVRSSDGIEQEEEENKCNSPMNEEKDKDDERLSKEQPGSVDDSAVREDKDAEVQEPRLYIICPDRPDLELSEPFISTPKACLFTLKEGSRYKLKFSFTVSNNVVSGLKYINTTWKSGVRVDKSEVMLGTFSPRKEPYVYELEEDVTPSGVFARGLYSARTQVIDEKGTCYVDIKYYFDIQKQWLQL

SEQ ID NO: 15335 - DNA, 708 bp, Nicotiana tabacum
  CDS (1)..(708)
atggattctgataaggagggtactaaagggggaacaaaaactccaattgctgattctgattctgagatcgaacacgagcctgttggtgagaaaaatgtaagcaggcaaatgagtgagagttccctttacactactgaggatgaggaggaagatgaaactaataacaagattgagttgggtccacaatgtactctcaaagaacaatttgaaaaggataaggatgatgagagtttgagaaggtggaaggagcagcttcttggaagtgtggatatcaattctgttggagaatccctggatccagatgtgaagatcttgagccttgaaattaagtctcctggtagacctgatattgttctccctatccccgaggacgggaaaccccacagcccatggtttacactgaaagaagggagcaaatacagcctaaaattctcatttcaagtcagcaataatatagtgactgggctcaaatacacgaacacagtttggaaaactggtatcaaagtggacagcacgaagcaaatgattggggcctttagtcctcagttggagccttatacacacgaaatgccggaggatactaccccttctggcatgtttgcaagaggatcttactcagcaaggacaaagttccttgatgatgataacaagtgctatttggagatcaactacacatttgaaatcaagaaagaatggcaggcaacataa

SEQ ID NO: 15336 - protein, 235 aa, Nicotiana tabacum
MDSDKEGTKGGTKTPIADSDSEIEHEPVGEKNVSRQMSESSLYTTEDEEEDETNNKIELGPQCTLKEQFEKDKDDESLRRWKEQLLGSVDINSVGESLDPDVKILSLEIKSPGRPDIVLPIPEDGKPHSPWFTLKEGSKYSLKFSFQVSNNIVTGLKYTNTVWKTGIKVDSTKQMIGAFSPQLEPYTHEMPEDTTPSGMFARGSYSARTKFLDDDNKCYLEINYTFEIKKEWQAT

SEQ ID NO: 15337 - DNA, 591 bp, Monacrosporium haptotylum
  CDS (1)..(591)
atggctgaccacgacgaggatcttaccgccaccgcgactgagggctataaagtcggagagaagaagtccctagccgaatatcagaaactcgatgccaacgatgaatctctcaacaaatggaaggcatccttgggtcttggagatggtgcagcagcatcaagtgaccccgcaaaggtcactatcaagaaactctctttactagtcgatggtcgggagcctctcgaaattgacctcacaaagcccaacgcgcttgagacactcgggacgcatccattcatcgttaaagaaggcacagaataccagatcgaaatcacattcgttgttgagaaccaaatcatcacgggcctcagatacgtccaggtagttaaaagaaaaggcatcaaggtggacagatcggaggaaatgatgggctcatacggcccaaatacggcgacaaaccccacctattcgaaaaaattgcctctggagactgcaccatccgggatgcttttacgcggtacttatgacgccgcatccgcgtttatcgacgatgataaacataatcacttgagcttcaactgggctatcaaaatcgcgaaggattggtcataa

SEQ ID NO: 15338 - protein, 196 aa, Monacrosporium haptotylum
MADHDEDLTATATEGYKVGEKKSLAEYQKLDANDESLNKWKASLGLGDGAAASSDPAKVTIKKLSLLVDGREPLEIDLTKPNALETLGTHPFIVKEGTEYQIEITFVVENQIITGLRYVQVVKRKGIKVDRSEEMMGSYGPNTATNPTYSKKLPLETAPSGMLLRGTYDAASAFIDDDKHNHLSFNWAIKIAKDWS

SEQ ID NO: 15339 - DNA, 702 bp, Medicago truncatula
  CDS (1)..(702)
atgggtcttgatgatgataatgtgaaaagtgataaggaagaagagaagagttcttgtgttgttgaaggaagtgataatgaaggtgctggtggtggtaacgatagcagatacatgagtgagagttctgttgctgctactgaggaggaagatgatgatgaagataggaagattgagttgggtccacaatgtaccttaaaggaacaacttgaaaaggataaggatgatgagagcttgaggaggtggaaggaacagcttcttggaagtgttgacatcaatgctgttggagaaactctggagccagaagtgaagattctgagccttgcaataaaagctgctgatagacctgatatagttcttccaataccagaagatggaaatccaaagggtttgtggtttactttgaaagaaggtagcaaatacagattaatgttcactttccaggtcaaccataacattgtttcaggtctcaagtacaccaacactgtgtggaaaactggtatcaaagttgatagcagtaaagaaatgattggaaccttcagtcctcaaactgagacttacactcatgagatgcctgaagagacaacaccatctgggatgtttgctagaggggcatattcagctagaagtaagtttgttgatgatgataacaagtgctacttggagatcaactacacttttgatatcagaaaggactggcagtaa

SEQ ID NO: 15340 - protein, 233 aa, Medicago truncatula
MGLDDDNVKSDKEEEKSSCVVEGSDNEGAGGGNDSRYMSESSVAATEEEDDDEDRKIELGPQCTLKEQLEKDKDDESLRRWKEQLLGSVDINAVGETLEPEVKILSLAIKAADRPDIVLPIPEDGNPKGLWFTLKEGSKYRLMFTFQVNHNIVSGLKYTNTVWKTGIKVDSSKEMIGTFSPQTETYTHEMPEETTPSGMFARGAYSARSKFVDDDNKCYLEINYTFDIRKDWQ

SEQ ID NO: 15341 - DNA, 660 bp, Medicago truncatula
  CDS (1)..(660)
atggagggtggaaaaaaatcacacgaacaagagcaagctggtccatcttctgctattgacaaaaccactgaaaaacccactcacacttttcatgttgctagtgaagacgaggaagacgaaggacaagtctttgttcctagtcctcttctttctctcaaggaacagattgagaaagacaaggaggatgaaagcctaaggaggtggaaggagaagcttttgggttccttggaaagtgatttagatgatcaattggaacctgaagtaaaattccactccattggaattctgtctgaggatttcggtgaaatcgttactcctttacctgtggaagaacatcagaacagccgtatgctattcactctaagggagggatctcgctatcagcttaagctacaatttagtgtgatgcacaaccttgtctctggcttgacttactccaacacagtgtggaaaggggggcttcaagttgatcagagtaaaggaatgttgggtacttttgctccccaaaagggtccatatgtatatgccttgaaagaagacaccactcccgctggtgcacttgcaaggggtgtttactctgcaaaacttaagtttgaagatgatgacaaaaggtgtcatatggaactcaaatatttgttcgagattaaaaaaagcggctag

SEQ ID NO: 15342 - protein, 219 aa, Medicago truncatula
MEGGKKSHEQEQAGPSSAIDKTTEKPTHTFHVASEDEEDEGQVFVPSPLLSLKEQIEKDKEDESLRRWKEKLLGSLESDLDDQLEPEVKFHSIGILSEDFGEIVTPLPVEEHQNSRMLFTLREGSRYQLKLQFSVMHNLVSGLTYSNTVWKGGLQVDQSKGMLGTFAPQKGPYVYALKEDTTPAGALARGVYSAKLKFEDDDKRCHMELKYLFEIKKSG

SEQ ID NO: 15343 - DNA, 681 bp, Nicotiana tabacum
  CDS (1)..(681)
atgatggagggtggcaacaacaaagaggaagcaggtccatcacgtggccttaactttagtgaagacaagagaaaggaggagttagaagagggagatagtgaggaagatgagcataatcaagattctgctactgatattattacaacaagttatgtacctggtcctctcctttctctcaaagatcaaattgaaaaggacaaggaggatgagagcttgaggaggtggaaagagaagctgcttggttgcctggaaagtgacttaaatggacaaatggaacctgaagttaagttccactcagttggaattctttcctccgactttgaggagataaatactccattgcctgttaaagaaggccagagcaaatctgttctttttaccctcagggagggctcagagtaccggcttaagctaacatttagtgttctgcacaatattgtttctggcttggcttacacaaatacagtatggaaggccggtcttcaagttgatcaaagtaagggaatgctgggcacctttgctcctcagcgagaaccttatatacatatgttagaagaggagaccactccatcaggtgcacttgcaagaggaacatatacagctaaacttaagtttgtggatgatgacaaaagatgtcatttggtgctcaactattcgtttgaaataagcaagggtaggtag

SEQ ID NO: 15344 - protein, 226 aa, Nicotiana tabacum
MMEGGNNKEEAGPSRGLNFSEDKRKEELEEGDSEEDEHNQDSATDIITTSYVPGPLLSLKDQIEKDKEDESLRRWKEKLLGCLESDLNGQMEPEVKFHSVGILSSDFEEINTPLPVKEGQSKSVLFTLREGSEYRLKLTFSVLHNIVSGLAYTNTVWKAGLQVDQSKGMLGTFAPQREPYIHMLEEETTPSGALARGTYTAKLKFVDDDKRCHLVLNYSFEISKGR

SEQ ID NO: 15345 - DNA, 711 bp, Arabidopsis thaliana
  CDS (1)..(711)
atggttttggaagatgagatgaagaaaggtgaagcgtcaggagagacatcagagaaaatggggttaagcagaaagaacagtgggagctctttgtctccgacagaggatgatgaagaagatgaagacaagaagctcgaactcggtcccatgatcgctctcaaagaacaactcgagagagacaaggatgatgaaagcctgaggagatggaaggaacagcttcttggcgtcgtggatttggaggatgtcggaggtaaaccaaattcattacttgatttagattccatggttcaaacaccggatccagtagtaaagatactagatctcacaattagatcaccagacagagaggaaatggtattgacaatacccgaagatgggttgccaaacccgaaaggcccttggtttacgataaaggaaggttctaaatacacacttgtcttcaacttccgtgtcacaaacaatatcgtttcgggccttcgctataacaataccgtgtggaaaaccggtgttaaagtggatagtacaaaagcaatgcttgggacgtttagtcctcaagctgagtcttaccaacatgtaatgcctgaagaaatgacaccgtctggtatgtttgctagaggatcctattccgcaagaactaagttcatcgatgacgataacaaatgctacttggagatcaactacaccttcgacatccgcaagagttggcaatga

SEQ ID NO: 15346 - protein, 236 aa, Arabidopsis thaliana
MVLEDEMKKGEASGETSEKMGLSRKNSGSSLSPTEDDEEDEDKKLELGPMIALKEQLERDKDDESLRRWKEQLLGVVDLEDVGGKPNSLLDLDSMVQTPDPVVKILDLTIRSPDREEMVLTIPEDGLPNPKGPWFTIKEGSKYTLVFNFRVTNNIVSGLRYNNTVWKTGVKVDSTKAMLGTFSPQAESYQHVMPEEMTPSGMFARGSYSARTKFIDDDNKCYLEINYTFDIRKSWQ

SEQ ID NO: 15347 - DNA, 723 bp, Arabidopsis thaliana
  CDS (1)..(723)
atgtctttggtatctggagccagggacatggggttcgacgacaacaacaacaacaagaacaacaaggatggagatgatgagaactcctcctccagaacaagagccgacgacgatgctcttagtcgacagatgagcgaatcttctctttgtgctaccgaggaggaagaagacgacgattccaaattgcaattgggtcctcagtacactatcaaagaacatctcgagaaggacaaggatgatgagagtctgaggaaatggaaggaacagcttctcggaagtgttgatgtcaccaacattggagagactcttgatccggaagtgaggattgatagcctcgccatcatatctcctggaagacccgacattgttctcttggttcctgagaatggaaatccaaagggcatgtggtttactttgaaagaagggagcaagtacaacttgaaattcacttttcatgttaacaacaacattgtctctggtcttaggtacaccaatacagtttggaagaccggtgtcaaagtggacagagctaaggaaatgcttggaacctttagtcctcagttggagccatacaaccacgtgatgccagaagagaccactccttctggcatgtttgctcgaggatcatattctgcaagaactaagtttcttgatgatgataataagtgctacttggagatcaactacagctttgacatccgtaaagaatggcctgcgctttga

SEQ ID NO: 15348 - protein, 240 aa, Arabidopsis thaliana
MSLVSGARDMGFDDNNNNKNNKDGDDENSSSRTRADDDALSRQMSESSLCATEEEEDDDSKLQLGPQYTIKEHLEKDKDDESLRKWKEQLLGSVDVTNIGETLDPEVRIDSLAIISPGRPDIVLLVPENGNPKGMWFTLKEGSKYNLKFTFHVNNNIVSGLRYTNTVWKTGVKVDRAKEMLGTFSPQLEPYNHVMPEETTPSGMFARGSYSARTKFLDDDNKCYLEINYSFDIRKEWPAL

SEQ ID NO: 15349 - DNA, 618 bp, Schizosaccharomyces pombe
  CDS (1)..(618)
atgagtgttaacaatgaagtatccgctgatcaacataaccctgaactagaggatgatacatttgagcatggacctccggtttctctgggagaaaagaaatcacttaatgaatatatgaagatggatgccgaagatgaatcattgcagaaatggaaagcatctctgggtatcacgggaacaggttattcaccctcgaatgatcgtagaacagttgttattttaaagctgagtttacttgttgacggccgtgacccagttgatgttaacatggaagatgcagcaagtgtcgaacaaatccgcaagaaagggttcactattaaggaaggaagcgagtttaagattggtgttaaatttcgtgtacaacacgaagtaatttcaggcttaagatatgtccaaactgttcgcagacgtggctttgttgttgacaaaacatctaccatgattggctcctatggaccttctgaaacaccttatgattttacctctgaaccagatgaggcacctacaggtatgctggctcgcggacattatgaagccaatggaaagtttgttgatgatgataaagtggtccatcatgaatttgtttgggcttttgacgttgcaaaaagctggaagtag

SEQ ID NO: 15350 - protein, 205 aa, Schizosaccharomyces pombe
MSVNNEVSADQHNPELEDDTFEHGPPVSLGEKKSLNEYMKMDAEDESLQKWKASLGITGTGYSPSNDRRTVVILKLSLLVDGRDPVDVNMEDAASVEQIRKKGFTIKEGSEFKIGVKFRVQHEVISGLRYVQTVRRRGFVVDKTSTMIGSYGPSETPYDFTSEPDEAPTGMLARGHYEANGKFVDDDKVVHHEFVWAFDVAKSWK

SEQ ID NO: 15351 - DNA, 654 bp, Oryza sativa
  CDS (1)..(654)
atggacagtaaggacaaggagaaggagcatgagcagaccgcgtcgggcaggaaccccgacgtgaacgacgtcgaggaggaggaggaggacgaggagggcaacaagcgcgccgtcgtgctcggcccccaggtccccctcaaggagcagctcgagctcgacaaggatgatgagagcctgaggaggtggaaggagcaactcctcgggcaggttgatactgaacagcttggagagactgctgagccggaggtgaaggtgctgaacctgaccatcctgtcgccggataggccggaccttgtactgccgatcccgttcgtccccgacgagaagggctacgccttcgcgctcaaggacgggagcacttacagcttccgcttcagcttcatcgtctccaacaacatcgtgtcaggcctcaagtacaccaacactgtctggaagactggagtaagagttgagaaccagaaggtgatgctggggacattcagtccccagctagagccctacacatatgagggtgaagaggagaccaccccagctggcatgttcgcaagaggttcctattctgctaaactaaagtttgttgatgatgatggcaaatgctacttggagatgagttactactttgagattaggaaggagtggccaaccatccaatga

SEQ ID NO: 15352 - protein, 217 aa, Oryza sativa
MDSKDKEKEHEQTASGRNPDVNDVEEEEEDEEGNKRAVVLGPQVPLKEQLELDKDDESLRRWKEQLLGQVDTEQLGETAEPEVKVLNLTILSPDRPDLVLPIPFVPDEKGYAFALKDGSTYSFRFSFIVSNNIVSGLKYTNTVWKTGVRVENQKVMLGTFSPQLEPYTYEGEEETTPAGMFARGSYSAKLKFVDDDGKCYLEMSYYFEIRKEWPTIQ

SEQ ID NO: 15353 - DNA, 813 bp, Oryza sativa
  CDS (1)..(813)
atgtcttcggcggccggtgaaccctcctcctcctccgccgccgccgccgccatctcttgctcctcctccaacgacgacgagaagccaccgccgtctctggaggggaaggagctgcggcgagtcgaggaagaggagcccgccgccgccgcgcgccccgagaagctcacggaggggtcctcgcgcgccgctgaggctgaggaggaggaggaggtggtggaggatgaggaggacgatgacgaggaagatgaggggaaggtggcggaggccatcgacctcggccccagggtcagcatcaaggagcagctcgagatggacaaggaggatgagagccttcggagatggaaggagcagcttcttggcagcgtcgatttgaactcagtcggagagtcactggagccagacgtgaggatcacaagcctgtgcatcctgtcaccggggcggccggacgtccttctgccgctgcccgtggagccgagcaactccaaggaaccatggttcaccctcaaggaaggcagcacgtacaggctcaagttcaccttctctgtcagcagcaacatcgtctctggcctccgctacaccaacaccgtatggaaggccggcatccgagtggacaaaaccaaggagatgcttggcacgttcagccctcagctggagccgtacacttacgtgacgcctgaggagacgaccccctcgggagtatttgctcggggatcatactctgcaaaaacaaagttcgtcgatgatgaccggaagtgctacctggagatcaactacaccttcgacatccgccgggactggccctgcaagtcctga

SEQ ID NO: 15354 - protein, 270 aa, Oryza sativa
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 15355 - DNA, 765 bp, Oryza sativa
  CDS (1)..(765)
atgtcttcggcggccggtgaaccctcctcctcctccgccgccgccgccgccatctcttgctcctcctccaacgacgacgagaagccaccgccgtctctggaggggaaggagctgcggcgagtcgaggaagaggagcccgccgccgccgcgcgccccgagaagctcacggaggggtcctcgcgcgccgctgaggctgaggaggaggaggaggtggtggaggatgaggaggacgatgacgaggaagatgaggggaaggtggcggaggccatcgacctcggccccagggtcagcatcaaggagcagctcgagatggacaaggaggatgagagccttcggagatggaaggagcagcttcttggcagcgtcgatttgaactcagtcggagagtcactggagccagacgtgaggatcacaagcctgtgcatcctgtcaccggggcggccggacgtccttctgccgctgcccgtggagccgagcaactccaaggaaccatggttcaccctcaaggaaggcagcacgtacaggctcaagttcaccttctctgtcagcagcaacatcgtctctggcctccgctacaccaacaccgtatggaaggccggcatccgagtggacaaaaccaaggagatgcttggcacgttcagccctcagctggagccgtacacttacgtgacgcctgaggagacgaccccctcgggagtatttgctcggggatcatactctgcaaaaacaaaggtaatgaaatctgataccgtgatacacctctga

SEQ ID NO: 15356 - protein, 254 aa, Oryza sativa
MSSAAGEPSSSSAAAAAISCSSSNDDEKPPPSLEGKELRRVEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKVMKSDTVIHL

SEQ ID NO: 15357 - DNA, 717 bp, Glycine max
  CDS (1)..(717)
atgtctgctgctgtgtctgcaaccaaggatgttcccttcaatgctcatctggaggaagatatcaaaaacaaagaaagcaacaaggttgttaatgttggggaagcagaccagattccttacaatgatgatgccgaaggaactgattcagagacagaggaagaccccaagttggaattggatcttggccctcagtgttccctcaaggaacagcttgagaaagataaagaggatgaaagtttgagaaaatggaaggagcaacttctgggaggtattgatgtgtctgctgttggagaaaacaaagagcccgaagtgaagatagtgagccttaccattatatgtccagggaggcctgacctcattctgccaattccatttacttctgatgctaagaagagtatcttcacccttaaggaaggaagtcaataccagttgaaattctctttcactgtctccaacaacattgtttctggcctcaaatacaccaatgttgtttggaaaactgggcttagagtggacaacacaaaaaaaatgttgggaacttatagcccaagccaggaactatatacatatgaattggaagaagaaactaccccttcagggttgtttgctaggggaacctattcagcaagaaccacgtttgtagatgatgatcggaaatgctacttggatactagttaccactttgaaattcagaagaattggcctacacccatctaa

SEQ ID NO: 15358 - protein, 238 aa, Glycine max
MSAAVSATKDVPFNAHLEEDIKNKESNKVVNVGEADQIPYNDDAEGTDSETEEDPKLELDLGPQCSLKEQLEKDKEDESLRKWKEQLLGGIDVSAVGENKEPEVKIVSLTIICPGRPDLILPIPFTSDAKKSIFTLKEGSQYQLKFSFTVSNNIVSGLKYTNVVWKTGLRVDNTKKMLGTYSPSQELYTYELEEETTPSGLFARGTYSARTTFVDDDRKCYLDTSYHFEIQKNWPTPI

SEQ ID NO: 15359 - DNA, 732 bp, Glycine max
  CDS (1)..(732)
atgtttgctgctgtgtcctccacaacctctcatttagaggaagagcttaaaaacaacaacaacaacaacaacaacgttggtggagaatcagaccagcccccttacaatgagggtgccaactctgatgttgctgaagaaactgagccagaggaagatgatgactccaagttggaatctaacaaagaactggatcttggccctcaattcaccctcaaggaacagcttgagaaagataaagatgatgtaagtttgagaaaatggaaggagcaacttctgggaagtgttgacatgtctgtcgttggaagtgaaagcaaagaccctgaagtaaagatattgagcctcattattacaagcccagacaagcctgacctcacccttccaattccatttactactgatgctaagaagagtcttttcatccttaaggaaggaagcaaatgccaaatgaaattcaccttcactgtctccaacaacatcgtttctggtctcaaatacacaaatgttgtttggaaaactggcgttagagtggacagcagaaaaaagatgttgggaacttttagtcccaagcaggaaccatatacatttgaattggaagaagaaactatcccttctggcatgttcgtcaggggaacctatgcagcaagaaccaagtttgtagatgacgatcgaaaatgctacttggatgtcagttactactttgaaattcagaagaacagaccaacacctcaatga

SEQ ID NO: 15360 - protein, 243 aa, Glycine max
MFAAVSSTTSHLEEELKNNNNNNNNVGGESDQPPYNEGANSDVAEETEPEEDDDSKLESNKELDLGPQFTLKEQLEKDKDDVSLRKWKEQLLGSVDMSVVGSESKDPEVKILSLIITSPDKPDLTLPIPFTTDAKKSLFILKEGSKCQMKFTFTVSNNIVSGLKYTNVVWKTGVRVDSRKKMLGTFSPKQEPYTFELEEETIPSGMFVRGTYAARTKFVDDDRKCYLDVSYYFEIQKNRPTPQ

SEQ ID NO: 15361 - DNA, 813 bp, Oryza sativa
  CDS (1)..(813)
atgtcttcggcggccggtgaaccctcctcctcctccgccgccgccgccgccatctcttgctcctcctccaacgacgacgagaagccaccgccgtctctggaggggaaggagctgcggcgagtcgaggaaaaggagcccgccgccgccgcgcgccccgagaagctcacggaggggtcctcgcgcgccgctgaggctgaggaggaggaggaggtggtggaggatgaggaggacgatgacgaggaagatgaggggaaggtggcggaggccatcgacctcggccccagggtcagcatcaaggagcagctcgagatggacaaggaggatgagagccttcggagatggaaggagcagcttcttggcagcgtcgatttgaactcagtcggagagtcactggagccagacgtgaggatcacaagcctgtgcatcctgtcaccggggcggccggacgtccttctgccgctgcccgtggagccgagcaactccaaggaaccatggttcaccctcaaggaaggcagcacgtacaggctcaagttcaccttctctgtcagcagcaacatcgtctctggcctccgctacaccaacaccgtatggaaggccggcatccgagtggacaaaaccaaggagatgcttggcacgttcagccctcagctggagccgtacacttacgtgacgcctgaggagacgaccccctcgggagtatttgctcggggatcatactctgcaaaaacaaagttcgtcgatgatgaccggaagtgctacctggagatcaactacaccttcgacatccgccgggactggccctgcaagtcctga

SEQ ID NO: 15362 - protein, 270 aa, Oryza sativa
MSSAAGEPSSSSAAAAAISCSSSNDDEKPPPSLEGKELRRVEEKEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 15363 - DNA, 645 bp, Zea mays
  CDS (1)..(645)
atggacgatcaggagaacgagaatgagcacgagaagcatgctgatgctgggactgacgtcgaggaagaagaggaggacgaagatggccacaagcgtgtcgtcgttcttgggccccaagtccccctcaaggaacagctcgagcttgacaaggatgatgagagcctgaggaggtggaaggagcaactcctcgggcaagtcgacaccgagcagctcggagagactgcggagccggaggtgaaggtgctcaacctgaccatcctgtcaccggggcggccagatctagtgctaccgatcccgttcgaggccgacgacaagggctatgcatttacgctcaaggatggcagcctctatagcttccgtttctccttcactgtctccaacaacatcgtttcaggcctcaagtacaccaacacggtctggaagactggagtcaaagtggagaaccagaaaatgatgctagggacattcagtccccagcaagagccgtacgtttacgagggtgaagaagagaccacacctgctggcatcttcgcaagaggttcctattctgctaagctaaagttttttgatgatgatggcaagtgttatttggagacgagttactactttgagattagaaaagagtggccagggccagcaacctaa

SEQ ID NO: 15364 - protein, 214 aa, Zea mays
MDDQENENEHEKHADAGTDVEEEEEDEDGHKRVVVLGPQVPLKEQLELDKDDESLRRWKEQLLGQVDTEQLGETAEPEVKVLNLTILSPGRPDLVLPIPFEADDKGYAFTLKDGSLYSFRFSFTVSNNIVSGLKYTNTVWKTGVKVENQKMMLGTFSPQQEPYVYEGEEETTPAGIFARGSYSAKLKFFDDDGKCYLETSYYFEIRKEWPGPAT

SEQ ID NO: 15365 - DNA, 618 bp, Triticum aestivum
  CDS (1)..(618)
atggaccataaggatgagcactccgcccaccccgaccaggaggtcgaggaggaggaggatgaggaggccaagcgcgccgtcgtgctcggcccccaggtgcccctcaaggaccagctcgagctcgacaaggatgatgagagtctgaggaggtggaaggagcaactgcttgggcaggtggacacagagcagctcggagagactgcggagcccgaggtgaaggtgctgaacctgaccatcctgtcgccggatcggccggacctggtcctgcccatcccattcgtccccgacgagaagggctacgcctttgcgctcaaggacggcagcgcctacagcttccgcttctcgttcatcgtctccaacaacattgtgtcggggctcaagtacaccaacaccgtctggaagactggagtaagagttgagaaccagaagatgatgctggggacattcagtccccaggcagagccctacacatatgagggtgaagaagagaccacccctgctggcatgtttgcaagaggctcctattctgctaaactaaagtttattgatgatgatggcaagaactacttggagatgagttactactttgagattaggaaggactggccagccgtatga

SEQ ID NO: 15366 - protein, 205 aa, Triticum aestivum
MDHKDEHSAHPDQEVEEEEDEEAKRAVVLGPQVPLKDQLELDKDDESLRRWKEQLLGQVDTEQLGETAEPEVKVLNLTILSPDRPDLVLPIPFVPDEKGYAFALKDGSAYSFRFSFIVSNNIVSGLKYTNTVWKTGVRVENQKMMLGTFSPQAEPYTYEGEEETTPAGMFARGSYSAKLKFIDDDGKNYLEMSYYFEIRKDWPAV

SEQ ID NO: 15367 - DNA, 732 bp, Glycine max
  CDS (1)..(732)
atgtctgctgctgtgtcctccacaacctctcatttagaggaagagcttaaaaacaacaacaacaacaacaacaacgttggtggagaatcagaccagcccccttacaatgagggtgccaactctgatgttgctgaagaaactgagccagaggaagatgatgactccaagttggaatctaacaaagaactggatcttggccctcaattcaccctcaaggaacagcttgagaaagataaagatgatgtaagtttgagaaaatggaaggagcaacttctgggaagtgttgacatgtctgtcgttggaagtgaatgcaaagaccctgaagtaaagatattgagcctcattattacaagcccagacaagcctgacctcacccttccaattccatttactactgatgctaagaagagtcttttcatccttaaggaaggaagcaaatgccaaatgaaattcaccttcactgtctccaacaacatcgtttctggtctcaaatacacaaatgttgtttggaaaactggcgttagagtggacagcagaaaaaagatgttgggaacttttagtcccaagcaggaaccatatacatttgaattggaagaagaaactatcccttctggcatgttcgtcaggggaacctatgcagcaagaaccaagtttgtagatgacgatcgaaaatgctacttggatgtcagttactactttgaaattcagaagaacagaccaacacctcaatga

SEQ ID NO: 15368 - protein, 243 aa, Glycine max
MSAAVSSTTSHLEEELKNNNNNNNNVGGESDQPPYNEGANSDVAEETEPEEDDDSKLESNKELDLGPQFTLKEQLEKDKDDVSLRKWKEQLLGSVDMSVVGSECKDPEVKILSLIITSPDKPDLTLPIPFTTDAKKSLFILKEGSKCQMKFTFTVSNNIVSGLKYTNVVWKTGVRVDSRKKMLGTFSPKQEPYTFELEEETIPSGMFVRGTYAARTKFVDDDRKCYLDVSYYFEIQKNRPTPQ

SEQ ID NO: 15369 - DNA, 645 bp, Zea mays
  CDS (1)..(645)
atggacgatcaggagaacgagaatgagcacgagaagcatgccgatgctgggactgacgtcgaggacgaagaggaggacgaagatggccacaagcgtgtcgtcgttcttgggccccaagtccccctcaaggaacagctggagcttgacaaggatgatgagagcctgaggaggtggaaggagcaactcctcgggcaagtcgacaccgagcagctcggagagactgcggagccggaggtgaaggtgctcaacctgaccatcctgtcaccggggcggccagatctagtgctaccgatcccgttcgaggccgacgacaagggctatgcatttacgctcaaggatggcagcctctatagcttccgtttctccttcaccgtctccaacaacatcgtttcaggcctcaagtacaccaacacggtctggaagactggagtcaaagtggagaaccagaaaatgatgctagggacattcagtccccagcaagagccgtacgtttacgagggtgaagaagagaccacacctgctggcatcttcgcaagaggttcctattctgctaagctaaagttttttgatgatgatggcaagtgttatttggagacgagttactactttgagattagaaaagagtggccagggccagcaacctaa

SEQ ID NO: 15370 - protein, 214 aa, Zea mays
MDDQENENEHEKHADAGTDVEDEEEDEDGHKRVVVLGPQVPLKEQLELDKDDESLRRWKEQLLGQVDTEQLGETAEPEVKVLNLTILSPGRPDLVLPIPFEADDKGYAFTLKDGSLYSFRFSFTVSNNIVSGLKYTNTVWKTGVKVENQKMMLGTFSPQQEPYVYEGEEETTPAGIFARGSYSAKLKFFDDDGKCYLETSYYFEIRKEWPGPAT

SEQ ID NO: 15371 - DNA, 645 bp, Zea mays
  CDS (1)..(645)
atggacgacacggagagagaaaaggagaaggagaaggagaagcacgactgcgggacggacgtcgaggacgaagaagaggacgaggaaggcaacaagcgcgtcgtcgtgcttggcccccaggtccccctcaaggaacagctcgagctcgacaaggacgatgagagcctgaggaggtggaaggagcagctccttgggcaggtcgacaccgagcagctaggagaaactgcggagccagaggtcacggtgctggacctgacgatcctgtcgccgggcaggccggacctggtccttcccatcccgttccaggcggacgacaagggctatgcgtttgctctcaaggacggcagcccctacagcttccgcttctccttcgtcgtctccaacaacatcgtgtccggcctcaagtacaccaacactgtctggaagactggcgtcaaagtggagacccagaagatgatgctgggaacgttcagcccccagctagagccctatatctacgagggcgaagaagagacgacacctgctggcatttttgctagaggctcctattccgctaaactaaagtttgttgatgacgatggcaagtgcttcttggagatgagctactactttgagattaggaaggagtggccaggaggccaatga

SEQ ID NO: 15372 - protein, 214 aa, Zea mays
MDDTEREKEKEKEKHDCGTDVEDEEEDEEGNKRVVVLGPQVPLKEQLELDKDDESLRRWKEQLLGQVDTEQLGETAEPEVTVLDLTILSPGRPDLVLPIPFQADDKGYAFALKDGSPYSFRFSFVVSNNIVSGLKYTNTVWKTGVKVETQKMMLGTFSPQLEPYIYEGEEETTPAGIFARGSYSAKLKFVDDDGKCFLEMSYYFEIRKEWPGGQ

SEQ ID NO: 15373 - DNA, 24 bp, Artificial sequence
  primer
atggccgaagaaagtaccgacttt

SEQ ID NO: 15374 - DNA, 25 bp, Artificial sequence
  primer
ttattttttgacaatttcgaccccc

SEQ ID NO: 15375 - protein, 191 aa, Artificial sequence
  consensus sequence
  Variant (2)..(5): Xaa in position 2 to 5 is any amino acid
  Variant (7)..(8): Xaa in position 7 to 8 is any amino acid
  Variant (13)..(13): Xaa in position 13 is any amino acid
  Variant (14)..(14): Xaa in position 14 is any or no amino acid
  Variant (17)..(18): Xaa in position 17 to 18 is any amino acid
  Variant (20)..(32): Xaa in position 20 to 32 is any amino acid
  Variant (33)..(48): Xaa in position 33 to 48 is any or no amino acid
  Variant (50)..(53): Xaa in position 50 to 53 is any amino acid
  Variant (55)..(78): Xaa in position 55 to 78 is any amino acid
  Variant (79)..(85): Xaa in position 79 to 85 is any or no amino acid
  Variant (87)..(88): Xaa in position 87 to 88 is any amino acid
  Variant (92)..(93): Xaa in position 92 to 93 is any amino acid
  Variant (95)..(99): Xaa in position 95 to 99 is any amino acid
  Variant (101)..(101): Xaa in position 101 is any amino acid
  Variant (103)..(105): Xaa in position 103 to 105 is any amino acid
  Variant (107)..(108): Xaa in position 107 to 108 is any amino acid
  Variant (111)..(111): Xaa in position 111 is any amino acid
  Variant (113)..(119): Xaa in position 113 to 119 is any amino acid
  Variant (121)..(122): Xaa in position 121 to 122 is any amino acid
  Variant (123)..(125): Xaa in position 123 to 125 is any or no amino acid
  Variant (128)..(131): Xaa in position 128 to 131 is any amino acid
  Variant (133)..(133): Xaa in position 133 is any amino acid
  Variant (135)..(137): Xaa in position 135 to 137 is any amino acid
  Variant (139)..(142): Xaa in position 139 to 142 is any amino acid
  Variant (143)..(145): Xaa in position 143 to 145 is any or no amino acid
  Variant (147)..(152): Xaa in position 147 to 152 is any amino acid
  Variant (153)..(155): Xaa in position 153 to 155 is any or no amino acid
  Variant (159)..(161): Xaa in position 159 to 161 is any amino acid
  Variant (163)..(163): Xaa in position 163 is any amino acid
  Variant (165)..(165): Xaa in position 165 is any amino acid
  Variant (167)..(171): Xaa in position 167 to 171 is any amino acid
  Variant (173)..(173): Xaa in position 173 is any amino acid
  Variant (177)..(180): Xaa in position 177 to 180 is any amino acid
  Variant (182)..(186): Xaa in position 182 to 186 is any amino acid
  Variant (188)..(188): Xaa in position 188 is any amino acid
  Variant (190)..(190): Xaa in position 190 is any amino acid
EXXXXDXXDESLXXWKXXLXXXXXXXXXXXXXXXXXXXXXXXXXXXXXVXXXXLXXXXXXXXXXXXXXXXXXXXXXXXXXXXXXXFXXKEGXXYXXXXXFXVXXXIXXGLXYXXXXXXXGXXXXXVDXXXXMXGXXXPXXXXXXXYXXXXXXXXXPSGXXXRXGXYXXXXXFXDDDXXXXLXXXXXFXIXK

SEQ ID NO: 15376 - protein, 18 aa, Artificial sequence
  protein pattern
  Variant (2)..(2): Xaa in position 2 is any amino acid
  Variant (4)..(4): Xaa in position 4 is Ala, Asn, Ser or Thr
  Variant (5)..(5): Xaa in position 5 is Ala or Val
  Variant (6)..(8): Xaa in position 6 to 8 is any amino acid
  Variant (10)..(10): Xaa in position 10 is any amino acid
  Variant (14)..(17): Xaa in position 14 to 17 is any amino acid
GXYXXXXXFXDDDXXXXL

SEQ ID NO: 15377 - protein, 11 aa, Artificial sequence
  protein pattern
  Variant (2)..(2): Xaa in position 2 is any amino acid
  Variant (3)..(3): Xaa in position 3 is Asp or Glu
  Variant (8)..(8): Xaa in position 8 is any amino acid
  Variant (9)..(9): Xaa in position 9 is Lys or Arg
  Variant (10)..(10): Xaa in position 10 is Trp or Tyr
DXXDESLXXXK

SEQ ID NO: 15378 - DNA, 393 bp, Saccharomyces cerevisiae
  CDS (1)..(393)
atgagaaaagagtcgtttctcactttttatttctcgaatcacctgtatttgtgccccgcgataatcaggctctcgagcgtatgtacacttgccagaactgattattatttaccatcaaatatagcagtgacctacgacatacaaatttcatctctcggattcacttaccgaattgatttttttcttgcactcttttctgacccggcacggccttttcttaccgagataaacaggaaaatagggcagtatgcgtgtgttatacgtgagagagagcaagcgggtgagtattcgtttcattacagtttatgcattaacataaacgtatacatattacacatacacatatacatagatagatacatatacgcatatattaatgctcaggtgcaataa

SEQ ID NO: 15379 - protein, 130 aa, Saccharomyces cerevisiae
MRKESFLTFYFSNHLYLCPAIIRLSSVCTLARTDYYLPSNIAVTYDIQISSLGFTYRIDFFLALFSDPARPFLTEINRKIGQYACVIREREQAGEYSFHYSLCININVYILHIHIYIDRYIYAYINAQVQ

SEQ ID NO: 15380 - DNA, 25 bp, Artificial sequence
  primer
atgagaaaagagtcgtttctcactt

SEQ ID NO: 15381 - DNA, 26 bp, Artificial sequence
  primer
ttattgcacctgagcattaatatatg

SEQ ID NO: 15382 - DNA, 1122 bp, Saccharomyces cerevisiae
  CDS (1)..(1122)
atggctgccgtcacattacatctaagagctgaaactaaacccctagaggcacgtgctgccttaacacctaccacggttaaaaaactgatagctaagggcttcaaaatatatgtagaggacagtccacaatctactttcaatattaacgaatatcgtcaagcaggtgccattatagtgcctgcaggttcatggaaaaccgctccacgcgacagaatcattataggtttgaaggaaatgcctgaaaccgatactttccctctagtccacgaacacatccagtttgctcactgctacaaagaccaagctgggtggcaaaatgtccttatgagatttattaagggacacggtactctatatgatttggaatttttggaaaatgaccaaggtagaagagttgctgcctttggattttacgctgggttcgcaggtgcagcccttggtgtaagggactgggcattcaagcaaacgcattctgacgatgaagacttgcctgcagtgtcgccttaccccaatgaaaaggcattggttaaagatgttaccaaagattataaagaagccttagccaccggagccagaaagccaaccgtgttaatcattggtgcgctaggaagatgtggttccggtgccatcgatctgttgcacaaagttggtattccagatgctaacatattaaaatgggatatcaaagaaacttcccgtggtggtccctttgacgaaattccacaagctgatatttttatcaattgtatatatctatcgaagccaattgctcctttcactaacatggagaaactgaataatcctaacagaagactaaggaccgtggtggacgtatcagcagacactaccaaccctcacaaccccatcccaatatacactgtggctactgtgtttaacaaacctaccgttctggtacctaccactgccgggcctaaattatctgtcatctctattgatcacttgccttctttgctgccaagagaagcttcagaatttttctctcatgatctcttaccatctttagagctcctacctcaaagaaaaactgctcctgtctgggttagagccaagaaattgttcgatagacattgcgctcgtgttaaaagatcttcaagattgtag

SEQ ID NO: 15383 - protein, 373 aa, Saccharomyces cerevisiae; identical to SEQ ID NO: 6151

SEQ ID NO: 15384 - DNA, 1110 bp, Streptomyces avermitilis MA-4680; identical to SEQ ID NO: 6152
  CDS (1)..(1110): transl_table=11

SEQ ID NO: 15385 - protein, 369 aa, Streptomyces avermitilis MA-4680; identical to SEQ ID NO: 6153

SEQ ID NO: 15386 - DNA, 1098 bp, Magnaporthe grisea 70-15; identical to SEQ ID NO: 6154
  CDS (1)..(1098)

SEQ ID NO: 15387 - protein, 365 aa, Magnaporthe grisea 70-15; identical to SEQ ID NO: 6155

SEQ ID NO: 15388 - DNA, 1152 bp, Gibberella zeae PH-1; identical to SEQ ID NO: 6156
  CDS (1)..(1152)

SEQ ID NO: 15389 - protein, 383 aa, Gibberella zeae PH-1; identical to SEQ ID NO: 6157

SEQ ID NO: 15390 - DNA, 1119 bp, Kluyveromyces lactis NRRL Y-1140; identical to SEQ ID NO: 6158
  CDS (1)..(1119)

SEQ ID NO: 15391 - protein, 372 aa, Kluyveromyces lactis NRRL Y-1140; identical to SEQ ID NO: 6159

SEQ ID NO: 15392 - DNA, 1113 bp, Debaryomyces hansenii CBS767; identical to SEQ ID NO: 6160
  CDS (1)..(1113)

SEQ ID NO: 15393 - protein, 370 aa, Debaryomyces hansenii CBS767; identical to SEQ ID NO: 6161

SEQ ID NO: 15394 - DNA, 3081 bp, Aspergillus nidulans FGSC A4; identical to SEQ ID NO: 6162
  CDS (1)..(3081)

SEQ ID NO: 15395 - protein, 1026 aa, Aspergillus nidulans FGSC A4; identical to SEQ ID NO: 6163

SEQ ID NO: 15396 - DNA, 1173 bp, Ustilago maydis 521; identical to SEQ ID NO: 6164
  CDS (1)..(1173)

SEQ ID NO: 15397 - protein, 390 aa, Ustilago maydis 521; identical to SEQ ID NO: 6165

SEQ ID NO: 15398 - DNA, 1053 bp, Silicibacter pomeroyi DSS-3; identical to SEQ ID NO: 6166
  CDS (1)..(1053): transl_table=11

SEQ ID NO: 15399 - protein, 350 aa, Silicibacter pomeroyi DSS-3; identical to SEQ ID NO: 6167

SEQ ID NO: 15400 - DNA, 1056 bp, Rhodobacter sphaeroides 2.4.1; identical to SEQ ID NO: 6168
  CDS (1)..(1056): transl_table=11

SEQ ID NO: 15401 - protein, 351 aa, Rhodobacter sphaeroides 2.4.1; identical to SEQ ID NO: 6169

SEQ ID NO: 15402 - DNA, 1053 bp, Silicibacter sp. TM1040; identical to SEQ ID NO: 6170
  CDS (1)..(1053): transl_table=11

SEQ ID NO: 15403 - protein, 350 aa, Silicibacter sp. TM1040; identical to SEQ ID NO: 6171

SEQ ID NO: 15404 - DNA, 1056 bp, Sulfitobacter sp. EE-36; identical to SEQ ID NO: 6172
  CDS (1)..(1056): transl_table=11

SEQ ID NO: 15405 - protein, 351 aa, Sulfitobacter sp. EE-36; identical to SEQ ID NO: 6173

SEQ ID NO: 15406 - DNA, 1044 bp, Roseovarius nubinhibens ISM; identical to SEQ ID NO: 6174
  CDS (1)..(1044): transl_table=11

SEQ ID NO: 15407 - protein, 347 aa, Roseovarius nubinhibens ISM; identical to SEQ ID NO: 6175

SEQ ID NO: 15408 - DNA, 1164 bp, Phaeosphaeria nodorum; identical to SEQ ID NO: 6176
  CDS (1)..(1164)

SEQ ID NO: 15409 - protein, 387 aa, Phaeosphaeria nodorum; identical to SEQ ID NO: 6177

SEQ ID NO: 15410 - DNA, 1119 bp, Ashbya gossypii; identical to SEQ ID NO: 6178
  CDS (1)..(1119)

SEQ ID NO: 15411 - protein, 372 aa, Ashbya gossypii; identical to SEQ ID NO: 6179

SEQ ID NO: 15412 - DNA, 1119 bp, Candida glabrata; identical to SEQ ID NO: 6180
  CDS (1)..(1119)

SEQ ID NO: 15413 - protein, 372 aa, Candida glabrata; identical to SEQ ID NO: 6181

SEQ ID NO: 15414 - DNA, 1107 bp, Schizosaccharomyces pombe; identical to SEQ ID NO: 6182
  CDS (1)..(1107)

SEQ ID NO: 15415 - protein, 368 aa, Schizosaccharomyces pombe; identical to SEQ ID NO: 6183

SEQ ID NO: 15416 - DNA, 1110 bp, Yarrowia lipolytica; identical to SEQ ID NO: 6184
  CDS (1)..(1110)

SEQ ID NO: 15417 - protein, 369 aa, Yarrowia lipolytica; identical to SEQ ID NO: 6185

SEQ ID NO: 15418 - DNA, 1122 bp, Saccharomyces cerevisiae; identical to SEQ ID NO: 6150
  CDS (1)..(1122)

SEQ ID NO: 15419 - protein, 373 aa, Saccharomyces cerevisiae; identical to SEQ ID NO: 6151

SEQ ID NO: 15420 - DNA, 24 bp, Artificial sequence
  primer
atggctgccgtcacattacatcta

SEQ ID NO: 15421 - DNA, 26 bp, Artificial sequence
  primer
ctacaatcttgaagatcttttaacac

SEQ ID NO: 15422 - protein, 389 aa, Artificial sequence; identical to SEQ ID NO: 6188
  consensus sequence
  Variant (2)..(3): Xaa in position 2 to 3 is any amino acid
  Variant (5)..(5): Xaa in position 5 is any amino acid
  Variant (7)..(8): Xaa in position 7 to 8 is any amino acid
  Variant (10)..(10): Xaa in position 10 is any amino acid
  Variant (12)..(12): Xaa in position 12 is any amino acid
  Variant (14)..(14): Xaa in position 14 is any amino acid
  Variant (15)..(15): Xaa in position 15 is any or no amino acid
  Variant (19)..(23): Xaa in position 19 to 23 is any amino acid
  Variant (25)..(27): Xaa in position 25 to 27 is any amino acid
  Variant (29)..(32): Xaa in position 29 to 32 is any amino acid
  Variant (35)..(35): Xaa in position 35 is any amino acid
  Variant (37)..(49): Xaa in position 37 to 49 is any amino acid
  Variant (50)..(54): Xaa in position 50 to 54 is any or no amino acid
  Variant (56)..(63): Xaa in position 56 to 63 is any amino acid
  Variant (65)..(66): Xaa in position 65 to 66 is any amino acid
  Variant (67)..(67): Xaa in position 67 is any or no amino acid
  Variant (70)..(70): Xaa in position 70 is any amino acid
  Variant (72)..(73): Xaa in position 72 to 73 is any amino acid
  Variant (75)..(75): Xaa in position 75 is any amino acid
  Variant (80)..(80): Xaa in position 80 is any amino acid
  Variant (83)..(85): Xaa in position 83 to 85 is any amino acid
  Variant (86)..(86): Xaa in position 86 is any or no amino acid
  Variant (89)..(89): Xaa in position 89 is any amino acid
  Variant (91)..(91): Xaa in position 91 is any amino acid
  Variant (94)..(94): Xaa in position 94 is any amino acid
  Variant (96)..(96): Xaa in position 96 is any amino acid
  Variant (98)..(98): Xaa in position 98 is any amino acid
  Variant (101)..(101): Xaa in position 101 is any amino acid
  Variant (103)..(108): Xaa in position 103 to 108 is any amino acid
  Variant (110)..(110): Xaa in position 110 is any amino acid
  Variant (113)..(114): Xaa in position 113 to 114 is any amino acid
  Variant (116)..(116): Xaa in position 116 is any amino acid
  Variant (118)..(118): Xaa in position 118 is any amino acid
  Variant (120)..(120): Xaa in position 120 is any amino acid
  Variant (124)..(124): Xaa in position 124 is any amino acid
  Variant (126)..(128): Xaa in position 126 to 128 is any amino acid
  Variant (129)..(129): Xaa in position 129 is any or no amino acid
  Variant (138)..(139): Xaa in position 138 to 139 is any amino acid
  Variant (142)..(142): Xaa in position 142 is any amino acid
  Variant (147)..(152): Xaa in position 147 to 152 is any amino acid
  Variant (154)..(167): Xaa in position 154 to 167 is any amino acid
  Variant (168)..(182): Xaa in position 168 to 182 is any or no amino acid
  Variant (184)..(193): Xaa in position 184 to 193 is any amino acid
  Variant (194)..(202): Xaa in position 194 to 202 is any or no amino acid
  Variant (204)..(205): Xaa in position 204 to 205 is any amino acid
  Variant (214)..(214): Xaa in position 214 is any amino acid
  Variant (216)..(216): Xaa in position 216 is any amino acid
  Variant (219)..(219): Xaa in position 219 is any amino acid
  Variant (221)..(225): Xaa in position 221 to 225 is any amino acid
  Variant (227)..(231): Xaa in position 227 to 231 is any amino acid
  Variant (232)..(234): Xaa in position 232 to 234 is any or no amino acid
  Variant (237)..(238): Xaa in position 237 to 238 is any amino acid
  Variant (241)..(242): Xaa in position 241 to 242 is any amino acid
  Variant (243)..(244): Xaa in position 243 to 244 is any or no amino acid
  Variant (247)..(248): Xaa in position 247 to 248 is any amino acid
  Variant (251)..(255): Xaa in position 251 to 255 is any amino acid
  Variant (256)..(256): Xaa in position 256 is any or no amino acid
  Variant (258)..(258): Xaa in position 258 is any amino acid
  Variant (262)..(267): Xaa in position 262 to 267 is any amino acid
  Variant (269)..(269): Xaa in position 269 is any amino acid
  Variant (271)..(275): Xaa in position 271 to 275 is any amino acid
  Variant (277)..(279): Xaa in position 277 to 279 is any amino acid
  Variant (280)..(282): Xaa in position 280 to 282 is any or no amino acid
  Variant (284)..(284): Xaa in position 284 is any amino acid
  Variant (286)..(289): Xaa in position 286 to 289 is any amino acid
  Variant (292)..(293): Xaa in position 292 to 293 is any amino acid
  Variant (295)..(299): Xaa in position 295 to 299 is any amino acid
  Variant (302)..(302): Xaa in position 302 is any amino acid
  Variant (304)..(304): Xaa in position 304 is any amino acid
  Variant (306)..(308): Xaa in position 306 to 308 is any amino acid
  Variant (310)..(313): Xaa in position 310 to 313 is any amino acid
  Variant (315)..(317): Xaa in position 315 to 317 is any amino acid
  Variant (319)..(323): Xaa in position 319 to 323 is any amino acid
  Variant (324)..(328): Xaa in position 324 to 328 is any or no amino acid
  Variant (330)..(330): Xaa in position 330 is any amino acid
  Variant (332)..(333): Xaa in position 332 to 333 is any amino acid
  Variant (336)..(336): Xaa in position 336 is any amino acid
  Variant (340)..(340): Xaa in position 340 is any amino acid
  Variant (343)..(343): Xaa in position 343 is any amino acid
  Variant (345)..(345): Xaa in position 345 is any amino acid
  Variant (348)..(352): Xaa in position 348 to 352 is any amino acid
  Variant (354)..(354): Xaa in position 354 is any amino acid
  Variant (358)..(359): Xaa in position 358 to 359 is any amino acid
  Variant (361)..(366): Xaa in position 361 to 366 is any amino acid
  Variant (367)..(380): Xaa in position 367 to 380 is any or no amino acid
  Variant (383)..(384): Xaa in position 383 to 384 is any amino acid
  Variant (386)..(388): Xaa in position 386 to 388 is any amino acid

SEQ ID NO: 15423 - protein, 40 aa, Artificial sequence; identical to SEQ ID NO: 6189
  protein pattern
  Variant (2)..(2): Xaa in position 2 is Ala or Gly
  Variant (4)..(4): Xaa in position 4 is Ala or Cys
  Variant (5)..(5): Xaa in position 5 is Phe or Tyr
  Variant (7)..(7): Xaa in position 7 is any amino acid
  Variant (9)..(10): Xaa in position 9 to 10 is any or no amino acid
  Variant (12)..(14): Xaa in position 12 to 14 is any amino acid
  Variant (15)..(16): Xaa in position 15 to 16 is any or no amino acid
  Variant (18)..(18): Xaa in position 18 is any amino acid
  Variant (21)..(22): Xaa in position 21 to 22 is any amino acid
  Variant (24)..(24): Xaa in position 24 is any amino acid
  Variant (26)..(26): Xaa in position 26 is any amino acid
  Variant (28)..(28): Xaa in position 28 is any amino acid
  Variant (32)..(32): Xaa in position 32 is any amino acid
  Variant (34)..(34): Xaa in position 34 is any amino acid
  Variant (35)..(35): Xaa in position 35 is Asp or Asn
  Variant (36)..(37): Xaa in position 36 to 37 is any amino acid

SEQ ID NO: 15424 - protein, 37 aa, Artificial sequence; identical to SEQ ID NO: 6190
  protein pattern
  Variant (2)..(2): Xaa in position 2 is any amino acid
  Variant (4)..(4): Xaa in position 4 is any amino acid
  Variant (5)..(5): Xaa in position 5 is Ala, Thr or Val
  Variant (6)..(6): Xaa in position 6 is Ile or Val
  Variant (7)..(7): Xaa in position 7 is any amino acid
  Variant (9)..(9): Xaa in position 9 is Cys or Val
  Variant (10)..(10): Xaa in position 10 is Ala or Ser
  Variant (11)..(11): Xaa in position 11 is Ala or Cys
  Variant (13)..(13): Xaa in position 13 is Pro or Thr
  Variant (14)..(14): Xaa in position 14 is Asp or Thr
  Variant (15)..(15): Xaa in position 15 is Asn or Ser
  Variant (16)..(16): Xaa in position 16 is Asp or Pro
  Variant (17)..(17): Xaa in position 17 is any amino acid
  Variant (20)..(20): Xaa in position 20 is Ile, Leu or Val
  Variant (22)..(22): Xaa in position 22 is Ile, Leu or Val
  Variant (24)..(24): Xaa in position 24 is Asp, Asn, Ser or Thr
  Variant (25)..(25): Xaa in position 25 is any amino acid
  Variant (26)..(26): Xaa in position 26 is Ala, Asn or Thr
  Variant (28)..(28): Xaa in position 28 is Ser, Thr or Val
  Variant (29)..(29): Xaa in position 29 is Phe or Trp
  Variant (30)..(30): Xaa in position 30 is Asp, Glu, Asn or Ser
  Variant (31)..(31): Xaa in position 31 is any amino acid
  Variant (33)..(33): Xaa in position 33 is any or no amino acid
  Variant (35)..(35): Xaa in position 35 is any amino acid
  Variant (36)..(36): Xaa in position 36 is any or no amino acid

SEQ ID NO: 15425 - protein, 34 aa, Artificial sequence; identical to SEQ ID NO: 6191
  protein pattern
  Variant (2)..(2): Xaa in position 2 is Asp, Glu, Ser or Thr
  Variant (4)..(5): Xaa in position 4 to 5 is any or no amino acid
  Variant (7)..(8): Xaa in position 7 to 8 is any or no amino acid
  Variant (10)..(10): Xaa in position 10 is any amino acid
  Variant (13)..(13): Xaa in position 13 is Ser or Thr
  Variant (14)..(14): Xaa in position 14 is any amino acid
  Variant (17)..(17): Xaa in position 17 is any amino acid
  Variant (19)..(19): Xaa in position 19 is Ala or Ser
  Variant (22)..(22): Xaa in position 22 is any amino acid
  Variant (23)..(23): Xaa in position 23 is Phe or Tyr
  Variant (24)..(24): Xaa in position 24 is Ala or Ser
  Variant (25)..(25): Xaa in position 25 is any amino acid
  Variant (26)..(26): Xaa in position 26 is Ala, Asp, Gly or Gln
  Variant (28)..(30): Xaa in position 28 to 30 is any amino acid
  Variant (32)..(33): Xaa in position 32 to 33 is any amino acid

SEQ ID NO: 15426 - protein, 19 aa, Artificial sequence
  protein pattern
  Variant (4)..(4): Xaa in position 4 is Phe, Trp or Tyr
  Variant (5)..(5): Xaa in position 5 is any amino acid
  Variant (8)..(8): Xaa in position 8 is Phe or Tyr
  Variant (13)..(13): Xaa in position 13 is Ile, Leu or Val
  Variant (14)..(14): Xaa in position 14 is Ala, Gly, Ser or Thr
  Variant (15)..(15): Xaa in position 15 is Ala, Ile, Leu or Val
  Variant (16)..(16): Xaa in position 16 is any amino acid
  Variant (17)..(17): Xaa in position 17 is Ala, Cys, Asp, Asn or Thr
  Variant (18)..(18): Xaa in position 18 is any amino acid
AFGXXAGXAGAAXXXXXXA

SEQ ID NO: 15427 - protein, 23 aa, Artificial sequence
  protein pattern
  Variant (2)..(2): Xaa in position 2 is Ile or Leu
  Variant (3)..(3): Xaa in position 3 is any amino acid
  Variant (4)..(4): Xaa in position 4 is Ala, Asp, Glu or Gln
  Variant (5)..(5): Xaa in position 5 is any amino acid
  Variant (6)..(6): Xaa in position 6 is Asp, Gly or Val
  Variant (7)..(7): Xaa in position 7 is Ile, Leu or Val
  Variant (9)..(9): Xaa in position 9 is Phe, Ile, Leu or Val
  Variant (11)..(11): Xaa in position 11 is Ala or Cys
  Variant (13)..(16): Xaa in position 13 to 16 is any amino acid
  Variant (17)..(18): Xaa in position 17 to 18 is any or no amino acid
  Variant (20)..(20): Xaa in position 20 is any amino acid
  Variant (21)..(22): Xaa in position 21 to 22 is any or no amino acid
EXXXXXXFXNXIXXXXXXPXXXF

SEQ ID NO: 15428 - protein, 16 aa, Artificial sequence
  protein pattern
  Variant (2)..(3): Xaa in position 2 to 3 is any amino acid
  Variant (4)..(4): Xaa in position 4 is Ile or Leu
  Variant (5)..(5): Xaa in position 5 is Ile or Val
  Variant (6)..(6): Xaa in position 6 is Ile or Leu
  Variant (12)..(12): Xaa in position 12 is Cys or Val
  Variant (14)..(14): Xaa in position 14 is any amino acid
PXXXXXGALGRXGXGA

SEQ ID NO: 15429 - protein, 24 aa, Artificial sequence
  protein pattern
  Variant (4)..(4): Xaa in position 4 is any amino acid
  Variant (5)..(5): Xaa in position 5 is Gly or Thr
  Variant (6)..(6): Xaa in position 6 is Ala, Cys, Thr or Val
  Variant (7)..(8): Xaa in position 7 to 8 is any amino acid
  Variant (10)..(10): Xaa in position 10 is any amino acid
  Variant (11)..(11): Xaa in position 11 is Ala, Asp, Glu, Gly or Ser
  Variant (12)..(12): Xaa in position 12 is any amino acid
  Variant (14)..(15): Xaa in position 14 to 15 is any amino acid
  Variant (16)..(16): Xaa in position 16 is Ile or Val
  Variant (17)..(17): Xaa in position 17 is any amino acid
  Variant (18)..(18): Xaa in position 18 is Ile or Val
  Variant (20)..(20): Xaa in position 20 is any or no amino acid
  Variant (22)..(23): Xaa in position 22 to 23 is any amino acid
  Variant (24)..(24): Xaa in position 24 is Asp, Gln, Arg or Ser
LTPXXXXXLXXXGXXXXXEXSXXX

SEQ ID NO: 15430 - protein, 15 aa, Artificial sequence
  protein pattern
  Variant (2)..(2): Xaa in position 2 is Glu or Pro
  Variant (3)..(3): Xaa in position 3 is any amino acid
  Variant (4)..(4): Xaa in position 4 is Asp, Glu or Gly
  Variant (5)..(6): Xaa in position 5 to 6 is any amino acid
  Variant (8)..(8): Xaa in position 8 is Phe, Ile, Leu or Val
  Variant (13)..(13): Xaa in position 13 is Ile, Leu or Met
  Variant (15)..(15): Xaa in position 15 is Asp or Glu
AXXXXXIXGLKEXPX

SEQ ID NO: 15431 - protein, 14 aa, Artificial sequence
  protein pattern
  Variant (2)..(2): Xaa in position 2 is His or Trp
  Variant (3)..(3): Xaa in position 3 is Ala, Leu or Val
  Variant (5)..(5): Xaa in position 5 is any amino acid
  Variant (7)..(7): Xaa in position 7 is Ala, Gln, Ser or Thr
  Variant (8)..(8): Xaa in position 8 is Lys or Arg
  Variant (9)..(10): Xaa in position 9 to 10 is any amino acid
  Variant (12)..(12): Xaa in position 12 is any amino acid
  Variant (14)..(14): Xaa in position 14 is Ala, Ser, Thr or Val
LXXRXEXXXXEXRX

SEQ ID NO: 15432 - DNA, 2001 bp, SACCHAROMYCES CEREVISIAE
  CDS (1)..(2001)
atgggaaagactaaaacaagaggcagaagacaccaagacaaacagagaaaggacgaatttgaacccagttcaaattctgcgaaggagcacatccagcaagaagagtctacttacaatgacgaagccgaaattaaagagactcagccacaaatgttttttggtgtgctagatagagaagaactggagtatttcaagcaagccgaatcgactttgcaattagacgccttcgaagcacctgaggaaaagtttcaattcgtcacgagcattattgaggaagcaaaaggtaaagaactgaaattggttacttcccaaataacttcgaaattgatggaacgagttattcttgaatgtgatgagactcagttaaaagacattttccaatctttcaatggcgttttcttcgggttgtcatgtcataaatatgcttcccatgttttagagactttatttgttagaagtgccgccttggtagaaagagaacttttaacaccaagttttgataacaatgaaaaagaagggccttatgtgactatggaaaatatgtttctctttatgttgaatgaactgaaaccgcacttgaaaactatgatgaaccatcagtatgcatcacatgttttgagattgctaatattaattttgtcttccaagacattgcctaattcaactaaagcgaactctactttacgttccaaaaagtcaaaaattgcaagaaaaatgattgacattaaagataatgacgatttcaataaagtttaccaaacaccggaatctttcaaatctgaacttcgtgacataataactactttatacaaaggatttactaatggtgccgagtcgcgttctgatatttcgcaatctactatcaccaaatttagagagtacagtgtggataaagtggcttcccctgtaattcagctcattattcaagtcgaaggtatttttgacagggaccgttcattttggagattggtcttcaatacagcagatgagaaggatcctaaggaggaatcattcctggaatatttactgtcagatcctgtcggttctcatttcttagaaaatgtgattggctctgccaggctaaaatatgttgaaagactttatcgtttatatatgaaagaccgtattgtgaaactagcaaaaagggatactacaggtgcctttgtagtgcgtgcattgctggaacatttgaaggagaaggacgtaaaacagatattggatgcagtagttcctgaattaagcatgcttttaaactcaaatatggattttggtactgctattatcaacgcaagcaataaacaaggtggttacttaagggatgatgtcattgctcaattaatacaaaaatattatccagaaaagtctgatgcaaagaatattttggaaagttgcctgttgttgagtgcatcgactttgggcaataccagagatgactggccaacagcagaagaaagaagacgatcagttttcttggaacaattaattgactacgacgacaagtttttgaatattaccattgacagcatgttggctctgcctgaggaaaggttgatacaaatgtgttaccatggagtattttcgcatgttgttgagcacgtactacaaactactagggtggacataattaagagaaaaatgctattgaacatactgtctaaagagtctgtaaatttggcatgcaatgtatatggctctcatataatggacaaattgtgggaatttacggcaaaattaacattatataaggagcgtattgctagagcattagttttagaaactgagaaggtgaagaatagtatttatggcaggcaagtgtggaagaattggaaactggaattatatgttagaaaaatgtgggattggaaaaaactaattaaggagcaagaatttgaaatatttccaaattctaaaccgctacagccaaagccagaaaagcactcaagagaaagaaataattcgaaggaaggaagcgccttcaaaaagcaaaagcactatagataa

SEQ ID NO: 15433 - protein, 666 aa, SACCHAROMYCES CEREVISIAE
MGKTKTRGRRHQDKQRKDEFEPSSNSAKEHIQQEESTYNDEAEIKETQPQMFFGVLDREELEYFKQAESTLQLDAFEAPEEKFQFVTSIIEEAKGKELKLVTSQITSKLMERVILECDETQLKDIFQSFNGVFFGLSCHKYASHVLETLFVRSAALVERELLTPSFDNNEKEGPYVTMENMFLFMLNELKPHLKTMMNHQYASHVLRLLILILSSKTLPNSTKANSTLRSKKSKIARKMIDIKDNDDFNKVYQTPESFKSELRDIITTLYKGFTNGAESRSDISQSTITKFREYSVDKVASPVIQLIIQVEGIFDRDRSFWRLVFNTADEKDPKEESFLEYLLSDPVGSHFLENVIGSARLKYVERLYRLYMKDRIVKLAKRDTTGAFVVRALLEHLKEKDVKQILDAVVPELSMLLNSNMDFGTAIINASNKQGGYLRDDVIAQLIQKYYPEKSDAKNILESCLLLSASTLGNTRDDWPTAEERRRSVFLEQLIDYDDKFLNITIDSMLALPEERLIQMCYHGVFSHVVEHVLQTTRVDIIKRKMLLNILSKESVNLACNVYGSHIMDKLWEFTAKLTLYKERIARALVLETEKVKNSIYGRQVWKNWKLELYVRKMWDWKKLIKEQEFEIFPNSKPLQPKPEKHSRERNNSKEGSAFKKQKHYR

SEQ ID NO: 15434 - DNA, 2280 bp, Gibberella zeae PH-1
  CDS (1)..(2280)
atgcccaagcctagaacaagacgtggcgtcggccgcgaggagaagaagcgaaagaggctcgaagaggctgaacagcagcaagaatcatacgagaacgactccaagcgccagcgcaccgtcgaagatgaaaacaacaatggctacgagtacccagatggccaagatgctcagcaaaatggcattggcgaaaccgagttctttggtatgctcgccgaagaggagcaagaatacttccgacgcgccgacgaactgctggagctgaaccaattcccctcggctgaagaccgcgacatctttctcgaaaacgtttacaaggaggcccagggcaaagagctcaagctcgccagcagtcaatcttgctcaagattgatggagcgaatcattcaactctccaataccgcacagaagaagcatctctttgaagcgttcggcggccactttctctccctcgttcagcaccggttcgctagccactgcgccgaggctctcttcttgaggtctgcgggtgtagtgtcgcaggaacttgctggattcgtctttgacaccaagggcaccgatacggatatgcaaaagcccgagacgtcaatggaggaccatttccttgcgacactagacgagctagagggagctctgtcctatcttgtcaccgaccgattcgcatctcacaccctgcgcgtgctcttgcttgtcctcgccggccgacctttagaagatgcctcagtgcgaagtctcgtcaagagcaagaagaaggagaagatttcagttgctggatctgctgccacagatgaggcaaaccagggcttgagagcagtgcctacctcgttcgccctggcagccaagaagattatccaggactcgaccgcaggaatggatgctactgctttgcgagtgctcgccagacaccccatcggaaaccctacgctccagcttcttctcgagctcgaccttaccctcaataagggtgagcaaaaagccgagtctgaacagccaaccctgctcttccagctcttgcccggtgctcccaagtcgctatacgacagttcatcagaagcctccgagtttgtcaacggcatgatctatgatttaatcggatcgcgactcatcgagaccctcatcacacatagccctggcaagatcttcaaggctctcaaccaaaacattttcctgcccagaatcgagggttatgtccgaaacgacatctcttcctatgccgccatccgtgtgctcaaccgcttgagtaaggacgatcttgtgcaggccgtggagaagattgcacccagcgtgcctcaactggttgtcaagtccaggctcaacgtcctcaagacacttttcgagagatgcaatgctcgtggagccaacgatgagatcaagaaactcaacaaggggctaaaggagggatgcggcacgactccagccgacctggtcatcttccttagtggtttgaaagatgaggaacagaagaagaaggatgtccagcagctgtctaagaacgagtacgctattcagtctcacggagcccaactcctcaccacactcctaaagatccccggtcctactaagggtgttcaagaatctcttcttgcccttgagccggctactatcgtccgcctcgccaccacctccatgcctaccgttaccgtcctcacaaccgccctgtccatttcatctgccaaccctgctttccacaagtccatcgctagcgccatcttgcctcacacacacgagcttgcagtttcgcaatttggccacaacctaatcaacgccatcgtcgaggtccccagcaagggcagagagcgaagtattccgttccacatgaaggaagcctttatggcacgactcggcgagcacgaagcagaactccgagacagctggatgggcagaagtgtttggcgcaactggaagggtgatatgtggaagacacgccgcggagattggaagatctggatgaaagaggttgatgttgacattccctcaaccctgcctcagcgtggacccaagactgcagagaaggagaagccaagatctaaacctactgaggagatcatggaggagcctatcgtagaggagcctgttgtcgaagagcctgttgctgaggataagatggacgtggatgagccggttgagcaggctgataacgacgacgatgccaagaaggagaagaagaagagcaagagggacaaaaaggagaaaaaggagaaaaaggagaagaaagacaagaaggaaaagaagaagaagagtaaatctgacgatgccaaggcagacgatgagatggaggagtaa

SEQ ID NO: 15435 - protein, 759 aa, Gibberella zeae PH-1
MPKPRTRRGVGREEKKRKRLEEAEQQQESYENDSKRQRTVEDENNNGYEYPDGQDAQQNGIGETEFFGMLAEEEQEYFRRADELLELNQFPSAEDRDIFLENVYKEAQGKELKLASSQSCSRLMERIIQLSNTAQKKHLFEAFGGHFLSLVQHRFASHCAEALFLRSAGVVSQELAGFVFDTKGTDTDMQKPETSMEDHFLATLDELEGALSYLVTDRFASHTLRVLLLVLAGRPLEDASVRSLVKSKKKEKISVAGSAATDEANQGLRAVPTSFALAAKKIIQDSTAGMDATALRVLARHPIGNPTLQLLLELDLTLNKGEQKAESEQPTLLFQLLPGAPKSLYDSSSEASEFVNGMIYDLIGSRLIETLITHSPGKIFKALNQNIFLPRIEGYVRNDISSYAAIRVLNRLSKDDLVQAVEKIAPSVPQLVVKSRLNVLKTLFERCNARGANDEIKKLNKGLKEGCGTTPADLVIFLSGLKDEEQKKKDVQQLSKNEYAIQSHGAQLLTTLLKIPGPTKGVQESLLALEPATIVRLATTSMPTVTVLTTALSISSANPAFHKSIASAILPHTHELAVSQFGHNLINAIVEVPSKGRERSIPFHMKEAFMARLGEHEAELRDSWMGRSVWRNWKGDMWKTRRGDWKIWMKEVDVDIPSTLPQRGPKTAEKEKPRSKPTEEIMEEPIVEEPVVEEPVAEDKMDVDEPVEQADNDDDAKKEKKKSKRDKKEKKEKKEKKDKKEKKKKSKSDDAKADDEMEE

SEQ ID NO: 15436 - DNA, 1998 bp, Candida glabrata CBS 138
  CDS (1)..(1998)
atgggtaagccaagagggaggaaactggaaaagaagatcaaggatcaagaatttcatccagaacaagatagtgagaaaataagtgagaattacaactacgatggtcatccagagtcagatactagtaacccacaaatgttctttggtgtgttagatagggacgaattagagtactttaagcaaacagaggctaccttatcattagacacttttgaaactgaggaagaaaaggcacaatttgtcactaatgttattcaggaagctgagggtaaggaattgaaacttgttacttcacaaatatgttctaaactaatggaaagactaattttaaattgtaatgatattcagttaaaaaagctattccaagcttttaatggtaacttttacaacatatcctgtcataagtatgcatcacatgtggtcgaaacattattggtcagaagtgcatctttggtggaaaaagaactaatcacaccacattttgataatatggatgcctctgttgatggaagtgatgtctttgctcctatggaatctttatttttatttatgctcaatgaaataaagccacacttgaaaagcatgattaatcatcaatatgcttctcatgttttgaggctaataatattaattctctcctcgaaaacattaccaagtacaacccaaaataattcaatagtacgttcaaaaaaatcgaaaattgcaaggaaaatgattgatttaaaggataatgaagacttcaataaagtatatcaaacacctgaatcatttaaatctgagctgaaaatgatgttaaatgatttatattccgatttaactggccatgcaaaaccaaaagcagaaattaacccaacggttataacgaaattcagagagttttgtgttgataaagtagcctcccctgttatccagcttatcatacaagttgaaggtatatttgatagagatagatcattttggcgacttgctttcaatacaaatgatgaaaaagacgccaaggaacaatcttttatggaatatctactttctgacccagtaggatctcattttttggagaatgtgataagttttgctaaaacaaaatatgtggagaggctatatcgagtctacattaaagatcaaattgtcaggttagcaaaaagagatactactggtgcttttgtaattcaatctttgctaaaaaatatgaaagataaagaagtaaaggaaatcctagatgctttacttccggatttgagtattcttttgaattcaaacatggattttggtacaacaatcattaatgcatgtatcaagcagaataactataagagggatgaagtcataggtcagctcatgaaaaagtattatccagacggttcatcggagaagaatattctggaaagctgtcttttgctggctagctccacattgggcaataccaaagatgactggccaactgctgaagaaaggagaagatcgatatttttggaggagttgattgactttgatgataaattcctagaagtagctattgagagtatgttgaatcttccagaagaaaggttactgcagatgtgttatcacggtgttttttctcatgttgttgagcatgtattgcaagttcaacgtgttgatataatcaaaaggaaattgttactaaacattttaattaaggatattgtaaagttggcatgcaatgcttatggatctcatattgtcgataagctttgggattttacagcaaagctgacattatataaggaacggattgcagcagctttagtagagaactctgagatggtgaaaaacagtgtttatggaagacaagtctggaagaattggcagctagagaaatatatacggaaaaggtgggaatggaagaagattattaaggaaagtgatttggaaacctttcccaatatgcgtgttcttcaacctaatatgcaagaaagggcagcaatcaagagaaagaatgatgacaaagcatttgatagcatgaaaaagtcaagaaaataa

SEQ ID NO: 15437 - protein, 665 aa, Candida glabrata CBS 138
MGKPRGRKLEKKIKDQEFHPEQDSEKISENYNYDGHPESDTSNPQMFFGVLDRDELEYFKQTEATLSLDTFETEEEKAQFVTNVIQEAEGKELKLVTSQICSKLMERLILNCNDIQLKKLFQAFNGNFYNISCHKYASHVVETLLVRSASLVEKELITPHFDNMDASVDGSDVFAPMESLFLFMLNEIKPHLKSMINHQYASHVLRLIILILSSKTLPSTTQNNSIVRSKKSKIARKMIDLKDNEDFNKVYQTPESFKSELKMMLNDLYSDLTGHAKPKAEINPTVITKFREFCVDKVASPVIQLIIQVEGIFDRDRSFWRLAFNTNDEKDAKEQSFMEYLLSDPVGSHFLENVISFAKTKYVERLYRVYIKDQIVRLAKRDTTGAFVIQSLLKNMKDKEVKEILDALLPDLSILLNSNMDFGTTIINACIKQNNYKRDEVIGQLMKKYYPDGSSEKNILESCLLLASSTLGNTKDDWPTAEERRRSIFLEELIDFDDKFLEVAIESMLNLPEERLLQMCYHGVFSHVVEHVLQVQRVDIIKRKLLLNILIKDIVKLACNAYGSHIVDKLWDFTAKLTLYKERIAAALVENSEMVKNSVYGRQVWKNWQLEKYIRKRWEWKKIIKESDLETFPNMRVLQPNMQERAAIKRKNDDKAFDSMKKSRK

SEQ ID NO: 15438 - DNA, 2007 bp, Kluyveromyces lactis NRRL Y-1140
  CDS (1)..(2007)
atggctagagtaagaggtagaaagctaataaaaaagctcaagaaagatgagttccatccagaagacaataaaacccatgatgagcctacggttagccatgttaatgaaactgctgggggtgacaatagtgatgtgagtcctaatactttctttggtgtcctagattctggcgaattggattattttaagaaggctgaatccacgttggctattgatacatttgagaatccagatgagaagtaccagtttatcaacagtgtcatcgaggaaagtaagggtaaagagttgaaacttgctacgtctcagatttcttctaagctaatggaacgtattattatggaaagtgatgaaactcaattgaagactatcttcaaagctttcaatgggttttatttcaaccttgcatgtcacaaatattcctcccatgttttagagactctattagtcagaggtgcagcacaggtggaaaaagaattgttaacacctgattttgattctgttgatgagggtgaattcgttactactgaatcattgtttttgtttttgactaacgagttgcaaccgaacttaaggttcatggtgagccatcaatatgcatcacatgtccttagaattttaatcttagtgctatcgtcaaagactttaccaagtactgtacagaacaattcaacattacgttccaagaagtctaagattgcacgtaagatgattgacattaaggataacgataactataacaaaatattcaagactcccgattcattcaaagttgttcttcgttctatgttatcttcaatctacactagtttcacacatggtattccacagggctctggacacttttctgagatttctctcgctgacgttatgaaattcagggaaatatgtgttgataagatcgggtctccagtgattcaattggtaatacaagtagaaggtatcttcgatagagacaggtcatactggcatctaatattcaaagattctgatgagaaggatcccaaggaagagtcatttgtggagtacttactatcagatgctgttggatctcatttcttgcagaatgttattgcatcaactagaatcaagtacgtggaaagattatacagattatacatgaaggatagaattccaaaacttgctaaaagagatacaactgctgcatttgtgttgcaatcacttttgaaagtcttgaactctaaggaagtcaaagagattatggatgaactggtcccagacttgagcgttttgttgaactctaacatggatttcggtactgaaattatagatgccagtatccgtcatgataattatttgagggacgaaatcattgaacaattaatgaagaaatactatcctcgtgagtcatctgataagaacatcttagaatcttgtcttcagttaagttcctctacccttggtaacactagagatgactggccaactgctgaagagaggagaaaatctctattcttagagaagttgattgattacgatgattgcttcctaaacagtaccattgacagtatgttgaatcttccagcagaaagacttttgcagatgccataccatggtgtgttttctcacgttgttgaacatgttctacaggttaaaagagttgccatcatcaaaagaaaactcttactcaatgtgttatgcaaagatatcgtaaacttatcctgtaacgcatatggttcccacattgttgataaactatggacatttacggctaaattggctatgtacaaggaacgtatagcaactgcgttatgtgcagactctgaaaaggtcaagaacagtgtttacggtagacaagtgtggaagaattggtcgcttgaactatttgtaagaaagagatacgactggaaaaaaatagtaaaagaacaagagctcgaaatgttcccagattctaaacctttacaaccaaagaccttcaagcgtcctaataataacaacaattcggatgtttcaccttctttcaagaagagcaagttccagaaaaaataa

SEQ ID NO: 15439 - protein, 668 aa, Kluyveromyces lactis NRRL Y-1140
MARVRGRKLIKKLKKDEFHPEDNKTHDEPTVSHVNETAGGDNSDVSPNTFFGVLDSGELDYFKKAESTLAIDTFENPDEKYQFINSVIEESKGKELKLATSQISSKLMERIIMESDETQLKTIFKAFNGFYFNLACHKYSSHVLETLLVRGAAQVEKELLTPDFDSVDEGEFVTTESLFLFLTNELQPNLRFMVSHQYASHVLRILILVLSSKTLPSTVQNNSTLRSKKSKIARKMIDIKDNDNYNKIFKTPDSFKVVLRSMLSSIYTSFTHGIPQGSGHFSEISLADVMKFREICVDKIGSPVIQLVIQVEGIFDRDRSYWHLIFKDSDEKDPKEESFVEYLLSDAVGSHFLQNVIASTRIKYVERLYRLYMKDRIPKLAKRDTTAAFVLQSLLKVLNSKEVKEIMDELVPDLSVLLNSNMDFGTEIIDASIRHDNYLRDEIIEQLMKKYYPRESSDKNILESCLQLSSSTLGNTRDDWPTAEERRKSLFLEKLIDYDDCFLNSTIDSMLNLPAERLLQMPYHGVFSHVVEHVLQVKRVAIIKRKLLLNVLCKDIVNLSCNAYGSHIVDKLWTFTAKLAMYKERIATALCADSEKVKNSVYGRQVWKNWSLELFVRKRYDWKKIVKEQELEMFPDSKPLQPKTFKRPNNNNNSDVSPSFKKSKFQKK

SEQ ID NO: 15440 - DNA, 2163 bp, Debaryomyces hansenii CBS767
  CDS (1)..(2163)
atggtacaaccaaaagttagaggtagaagggctgaaaaaaagtcaaaggaggttaatactcagccagaggattatagtcccaatgacagaagtgaactcgaagaaaatgacgataaagttgaactgaaccctgctcttaagacgaccttttttggtttagttgactcgaatgaaattgactatttcaagcaagcggaatctactttaaatgttaatgcatttgataatgatgaagagcgtgaaggatttattagatctgtattggaagaagctcgtggaaaggaattaaagcttgtcactaaccagatctgttccaagttaatggaaagattagtattgtttgcgactgatagacaattaaagaatatcttcagacaattttctggacactttgttgcattagcacatcataaatattcgtcgcatgttttagagacattattagtcagagcagctgcattgatcgaaaaagaattagttaatgattttaagcaagatgaaggtgaagttgatgatgagataagccaagacaacgacagggaagatgaagctgttgtatctatggaaacattatttgttaaaatgttggatgaatttaatccacacttgaagaccatggttgatcatcaatattcgtctcatgttttaagattgttaatcttgattattgcaggtaaagagttgccttccacaacaacatcaaattccactttacgttccaaaaagtctaagattgcaagaaaaatgattgagattaaggataatgatgactttaataggtcatttcaaactccaccttcgttcaaagatcaattaagaaaactttgtaatagtcttggttctaagggagatatgaaacacatgagagaattggcgattaataaggtcgcctcccctgttttgcaattgcttattcaagttgaaggtatagtagataaagagagaacgttctggcatttaatatttttgagtgaaaattcggataaaaaccctcaagaggaagcattcgttgaatatttgctttcagattcagtaggttcacatttcttagaatctgttattagaaatggtggtgcaagaatgaaatacattgaaagattatacaagttatatatgaaagacagagttttgaagttatccaagagatcaaccacaggtgtatttattattcaagcattattattcaagttaaaacccgccgaagttttatttatcttggatcaaataattccagaattggccagtttaatttcaattgatgaaaatcaaaatctagaattaggtaagaatattattgatgcttccattagcagagataattatagaagagaagaacttattgagcagttatttgtaaaatttgctcctaattatgacagacataatccaagcgctgatacatcttcagaatttttggagaatactttacatttaactggttctacattaggtaatacaagagatgattggccaacagcacaagaaagaagaagatcattatttttagaaaaattgatggaatacgatcattcatttgttgtctgtacttggttaaactttttagctttgccaattgctaggtttattcaaatgtgttaccatggggtcttttctcatgtggttgaaaattcattagtagttatcccagcatcagaaggagaaccaaaaagtgttcttattatcagaaaaaggtttttgaatttattccagaatgaaattgtgaacttggcctgtaattcgtatggctcccatatagtcgacagactttggaatttcactgtattacttaacatgtataaggatagaattggatcagagttagcttcagaatcgcataaagtaaaagaaagtacttatggtagattggtttggaagaattggtctatggaattatttgtcagaaagaaatttgactggaagctgttggttaaaaatcaggaagaagaatactttggcgtaggttcacacgaaggtcaaaatagtactgaaagagtgaaaaagcctattgaattaaaatttgagcaaatgatgaaagaaaagcaaatgaaggaggagagagcacagaaagctgaagaaggttttaataaacgtaagaacaatgagtttgaatatggatatgacaacgataataagaaggcaaagataagaggccgtaaccgttag

SEQ ID NO: 15441 - protein, 720 aa, Debaryomyces hansenii CBS767
MVQPKVRGRRAEKKSKEVNTQPEDYSPNDRSELEENDDKVELNPALKTTFFGLVDSNEIDYFKQAESTLNVNAFDNDEEREGFIRSVLEEARGKELKLVTNQICSKLMERLVLFATDRQLKNIFRQFSGHFVALAHHKYSSHVLETLLVRAAALIEKELVNDFKQDEGEVDDEISQDNDREDEAVVSMETLFVKMLDEFNPHLKTMVDHQYSSHVLRLLILIIAGKELPSTTTSNSTLRSKKSKIARKMIEIKDNDDFNRSFQTPPSFKDQLRKLCNSLGSKGDMKHMRELAINKVASPVLQLLIQVEGIVDKERTFWHLIFLSENSDKNPQEEAFVEYLLSDSVGSHFLESVIRNGGARMKYIERLYKLYMKDRVLKLSKRSTTGVFIIQALLFKLKPAEVLFILDQIIPELASLISIDENQNLELGKNIIDASISRDNYRREELIEQLFVKFAPNYDRHNPSADTSSEFLENTLHLTGSTLGNTRDDWPTAQERRRSLFLEKLMEYDHSFVVCTWLNFLALPIARFIQMCYHGVFSHVVENSLVVIPASEGEPKSVLIIRKRFLNLFQNEIVNLACNSYGSHIVDRLWNFTVLLNMYKDRIGSELASESHKVKESTYGRLVWKNWSMELFVRKKFDWKLLVKNQEEEYFGVGSHEGQNSTERVKKPIELKFEQMMKEKQMKEERAQKAEEGFNKRKNNEFEYGYDNDNKKAKIRGRNR

SEQ ID NO: 15442 - DNA, 2175 bp, Yarrowia lipolytica CLIB122
  CDS (1)..(2175)
atgcctcgagaagtcaagaagagaggaagacgagccgccgccaagcgagccgaggaggaaaaggaagacgttgaccttaaggtctatgagaacgacgaagactacgtcacttttgatgctgacggaggagtggctggaggtcatgatgatgaagagaacgatggctacgacaatgagaccccctacaaccctctggatctcaagcagatgccattttttggattcctcgatgaccaggagtcagagtactttaaaaccgccgagtccactttggccgtcgatgcttttgggtcacccgaagagaagctgggattcatctctggtttgctggacgaggctcgaggaaaagagcttaagctggtgacgaaccagatttgctccaagctcatggagcgactgatcttgctggccaacgacgagcagatccgggcgttgtttgaggtgttctccggctactttgtggacctcagcagacacaagtactcttcccattgcgtggagactctgctggtgcgaggagccgccattgtggagaaggaggtgctagaccccaactttgatggcgacagcgaggattctatggagaagcggttcttgacccttgcaaacgacatgaaggactacatccaggacctcatttccaacccttacgcttcgcacgtgattcgagtgctgttgctcattctcggaggccagactctgccctctcccacaagttccgagggcaactcgtcggtgctgcgatcgaaaaagtcgcgaaccgcccgacgaaatattgacattaaggactcggaggagaatgaccgagcataccagattcccggagccttccacgatgctctggaggccattgtcagcggcttcagcaaacgactcaagcccactgctgctcgagagctagctattggacaggtttcttcgcccgtggtccaactgctgattgactctgaggctaccacttctgagcagcgacctctgttgaacaccatctttgccgacaccgaagatcgagactcctctgaggaggcgtttgttgagcaccttctgtccgatgctgtgggttcgcactttctccagaacgtgcttcagaaggcccctgaggcctttgtcgagcgactctacagactgtacatgtctcagcgagtgcagaagttggtgcgacgagactacgccggatttgtcattgagacctgcatgcagcgtcttcccgaggccgacgtccaccacattattgatactgccatgggagaaattccctatctggtggagaacaacaacctgaccatggttcgaattctgcttacccgagctgctgctgccaactacaaggcaaccgacgttgccaatgcggtgctcaagacatttgatacagactccaccgaccccaagctcctacagaaggtgcttcagctggacgagaagaacccctacaaaccccatgaggcttcttctcccggtctgcatagatgtctggtgctgcaacaactggtggaagcttctcccgaggtgcttgctaccgctttcgtgggactcaactctggcgatgtcgatgtcatcaagatggccaagcaccagtcgtactcgcgtctgctggaaaagtgtctgcggccgtccatcaacacgatcgagcgacgaaagttcctcaacaagatcaacggccagtgcgtcgatcttgcccgagacccgtttgcatcacacgttatggaccggctttggaacttcacctacaagatgaacaactttagagagaagattgctaacgagctggtggccgacgaagatctcaaggaaaacacatatggaaaggcggtctggagaaattggtcgctggacaagtttctgcgacgaaagagtgactggtgggtgactctccatgccactgatgacgctttagccaaggagtacgaggagctcggaatccctctggacgccaagtctctggccaatcctggacagaagcgatttggccgaggtggagcccgaatcatcactcgaggaggaggaactttccctcgaggaggaggtcggggccgaggaggtttccgaggaggtcgaggcggggctccccgaggaggatttggaggctctgatcgaggaggattcaagcgagccaacggaggagatggagaagacgcctctggagaccgatctcgaaagaaggtccgaaacgagtga

SEQ ID NO: 15443 - protein, 724 aa, Yarrowia lipolytica CLIB122
MPREVKKRGRRAAAKRAEEEKEDVDLKVYENDEDYVTFDADGGVAGGHDDEENDGYDNETPYNPLDLKQMPFFGFLDDQESEYFKTAESTLAVDAFGSPEEKLGFISGLLDEARGKELKLVTNQICSKLMERLILLANDEQIRALFEVFSGYFVDLSRHKYSSHCVETLLVRGAAIVEKEVLDPNFDGDSEDSMEKRFLTLANDMKDYIQDLISNPYASHVIRVLLLILGGQTLPSPTSSEGNSSVLRSKKSRTARRNIDIKDSEENDRAYQIPGAFHDALEAIVSGFSKRLKPTAARELAIGQVSSPVVQLLIDSEATTSEQRPLLNTIFADTEDRDSSEEAFVEHLLSDAVGSHFLQNVLQKAPEAFVERLYRLYMSQRVQKLVRRDYAGFVIETCMQRLPEADVHHIIDTAMGEIPYLVENNNLTMVRILLTRAAAANYKATDVANAVLKTFDTDSTDPKLLQKVLQLDEKNPYKPHEASSPGLHRCLVLQQLVEASPEVLATAFVGLNSGDVDVIKMAKHQSYSRLLEKCLRPSINTIERRKFLNKINGQCVDLARDPFASHVMDRLWNFTYKMNNFREKIANELVADEDLKENTYGKAVWRNWSLDKFLRRKSDWWVTLHATDDALAKEYEELGIPLDAKSLANPGQKRFGRGGARIITRGGGTFPRGGGRGRGGFRGGRGGAPRGGFGGSDRGGFKRANGGDGEDASGDRSRKKVRNE

SEQ ID NO: 15444 - DNA, 2181 bp, Phaeosphaeria nodorum
  CDS (1)..(2181)
atgcccaaggaacacaagaagcgcggccgccgcgaagagcagaaaaagcggaagcgcgaccacgaccatgtcgacgccgctccgaagcgcctgaagaaggaagacgacgtcgagcttgagtccatcgaaaatggtgaggcgttccaccatgagcccgtcgacgttaccagacccggcgagctcacctactatggcatgctcgacgacgaggagcaggagtacttcaagcgcgccgacgagatgctggagctgaaccagttcgaggatccagaggcgcgcaacttattcctcgccagcgtgtacaaggaagccgacgggaaagagctgaagattgcgaatagccagtcgtgctcgcgcctgctggagcgcctgatccttctttcctcgccagaccagctgaaaaacctgttccagaagttcaacggacacttcctcaacctggtgcagcaccggtttgcctcccactgctgcgaagcacttttcatacatgccgcccccgtcgtcactctcgagcttgccgaaccgcagaccttacaaacgccgccctcctcagatcctaatgccatcatcgtttccatggagagcttgtttctttacaccctggccgagctagaggagcaccttggctacctaatgaccgaccgcttcgcttcccatgtcctgcgagttctgctcgttgtcctctctggcgcgccactcgcgaaagagaacaagaacaagtcggtattgcaaagcaagaggaaagaaaaggtcggcatcgcaggaaccgagagaggacaggattgggttttggagaagagaccagttcccaaatcttttctggaagctctggagaagacgatcaacgccagcgcttccactctcgacaccgcaaaccttcgcctcctcgccacacatcctctcggcaacccgacgctgcaactcctgctgaagctggaacttgcgcacttcgggaagtcgagggcaaaggatgaaaactcaatcattcacaagatgctgccggacgaccccattgcagaagggacggaaagcgcagccttcatcaacggcctcgtatacgaccccattggctcccgactactggaaactatcatcgaaagtgcgcccggcaagctgttcaagcagatatactcggaattcttcaaggaaagaatgggcagcttgtcacgcaacgaaattgctggctacgtagctggcaagatcctggaaaggttaggaaaggacgacctggacgaagcgatgcgccagattgtcgagcagatcccaaatctcgtcgagcgaaatcgaacggctatcatcaagactttgctcgagcgatgcatcgcccgcaacgtggacatatcactcatcaaggatcagttggaggcagtctacagcggtcccaacggctttgaggtgacgcgcattctcagagtcagtgagagcccagcggagaacttgaagcaaaacggcaagcaggatcactcgccagagaaggttcacggatcgctacttgcgcaaacgatgatggcagtcgatggccctctaggcgacctcatcttcgattcactcgcgaaacttaccccagaactttcagttcagcttgcgcgcgaccccaccgcatcgcgaactcttcaagccgcactaactgcagaacatgcctcggtcattttccgccgcaagatgatacaacagttttacggtcacgttggtgagctagcgctcgatccagcagcctcccgcgtcatcgatgctgtctggcacggcacacatggcctcgcgttcattcgcgagcgcattgcagaggagcttgccgagaacgagaactcactccgagaatccttcgtcggtcgcgcggtatggagaaactggcgcatggatctctacaagcggaagaggggcgattgggtcaagcagtcgaaatacaccgcgggcaacgacggcttccagtcattccccgagagcaacggcgagtcttccacaacacctccgcatcgtcagagccatgctcaaaaccaaagaggcggcaagcacatgagcgcgatcgaacttgctaggcaaaaacatgctgcgaaagctgtggaggcgaagaaaagggaagcgcaaacagacaagaagatgaaaagggagaaaaaagataaacatgttggtgttgctgagagcagcaaaggcaaggaaaaagcaagtgtcgtggcacaatag

SEQ ID NO: 15445 - protein, 726 aa, Phaeosphaeria nodorum
MPKEHKKRGRREEQKKRKRDHDHVDAAPKRLKKEDDVELESIENGEAFHHEPVDVTRPGELTYYGMLDDEEQEYFKRADEMLELNQFEDPEARNLFLASVYKEADGKELKIANSQSCSRLLERLILLSSPDQLKNLFQKFNGHFLNLVQHRFASHCCEALFIHAAPVVTLELAEPQTLQTPPSSDPNAIIVSMESLFLYTLAELEEHLGYLMTDRFASHVLRVLLVVLSGAPLAKENKNKSVLQSKRKEKVGIAGTERGQDWVLEKRPVPKSFLEALEKTINASASTLDTANLRLLATHPLGNPTLQLLLKLELAHFGKSRAKDENSIIHKMLPDDPIAEGTESAAFINGLVYDPIGSRLLETIIESAPGKLFKQIYSEFFKERMGSLSRNEIAGYVAGKILERLGKDDLDEAMRQIVEQIPNLVERNRTAIIKTLLERCIARNVDISLIKDQLEAVYSGPNGFEVTRILRVSESPAENLKQNGKQDHSPEKVHGSLLAQTMMAVDGPLGDLIFDSLAKLTPELSVQLARDPTASRTLQAALTAEHASVIFRRKMIQQFYGHVGELALDPAASRVIDAVWHGTHGLAFIRERIAEELAENENSLRESFVGRAVWRNWRMDLYKRKRGDWVKQSKYTAGNDGFQSFPESNGESSTTPPHRQSHAQNQRGGKHMSAIELARQKHAAKAVEAKKREAQTDKKMKREKKDKHVGVAESSKGKEKASVVAQ

SEQ ID NO: 15446 - DNA, 2124 bp, Aspergillus oryzae
  CDS (1)..(2124)
atgcctcgtgagaaccaaaaaagaggtcgccgagcggccgaaaaagctgagaaagacgccgcgaaacggaagcgcgaggaagtccccgaagattcactgccgaaacggttgaagccctcgacggacgagtcgaccgaaatcaatcaaggagctgactacatacctttcgacgagaattacaatgagaactacgatgggaactatgatgagaatcaagctgatgcgcctgcgggtgatatgcccttttatggtcttctcgatcccgaagaacaggaatatttctctcgagcgaacgaggttttggaattgaaccaattccaggatgcagaggagcggaggatattcatcgacagtgtctataaagaggccaatgggaaggagttgaaaatcgcttgcagtcagggatgctcacggctcatggaaaaattgatatcgatgtcggatatgcgccaaattcacaggctatttaacaaattcattggtcacttcatgaatcttgtgcagcatcggtttgctagccattgctgcgagaccctctttatcaatgctgcacccggcgtaacgcagaaagtctcgaaatcgaaaagcgataagatggatgtagacgaggaagaaggagaggagcccgagcctgaactgtcgttggcggagatgttcatcaaggtggtcgaagaattggaaggcaactggggttacctactgacagaacgatttgcgtcacatacaatcagagttttgcttcttgtgcttgcgggagagccggtggacgtttcagcgaacgactcggttgttgcaagccgcaagaaagagaaattgggcctacctcagggagagacacaggatggggatgtctccgcccaaaaaagaagcgtaccggatgtgttcgaggctaccttgaagaagattatgaaggacatcgtctcggtacttgatgacacatatttgagagcacttgcgactcaccctgttggtaatccggtgcttcaagtcttagtgtctctggagctctcgcactttggaaaatcgagtgcaaaggatccaaattctataacaagacgactaattccagatgagagctttgaggagggctctgagaccacaacgtttgtgcgcggattactctatgacccagtaggatctcgattactggagaccattgtgcgttgcatgcccggaaaggcgttcaagggcctttacaagaacttcatccgcgaccaaatcacttcccttgcgcgcaatatcaccgcagggtatgttgtgcttcgagtgctggagagactcggaaaggacgatctccaaaacgctctggagcgaattgttcctcaggttcccagtcttctcgagcggtcaagaatggtcgttcccaaggtgcttattgagcggtgtctagtccgtggagttgacacagcaccccttgctcgggcactggaggaagcctacgataaagaccctgctcggagactggaacaaattttgcggcttgagagcacaacccaagaggatttagaagagtcagagcagaaaccaaagggggccaatgctgctccaagccaatcatcaacaggagagaaactccatggttcgctacttgcacaaacaatgctcactgctcctgggccgataagtgggcttatttattcgagtctgttggcgcaatcttcggagtcactcgttaagatcgccaaggatcctaccgcatctcgcgttctacagcaagctcttacagttccgacatctagcgctcaattccgtcgacagtttgctccacgcttcaccagtcacttgaaggagcttgccctcgatagcagcggatcccatgtggtagacgcactctggcctgccaccaaggacattttctttatcaaggagcgaatggcacaggagttgacccagcatgagatggcgcttcgggactctttcgtcggccgtgcggtctggaggaactgggcgatggacctctacaagcgacggcggggcgaatgggctatgaaagccaaaggtattgataacaacaatggctccggagaacgacccaagtctaggatcgaactcgcacgggctaagtttgctgccaaggcagaggaggatgcgaagaaaggtgcgcagaagggcgtaactgcctga

SEQ ID NO: 15447 - protein, 707 aa, Aspergillus oryzae
MPRENQKRGRRAAEKAEKDAAKRKREEVPEDSLPKRLKPSTDESTEINQGADYIPFDENYNENYDGNYDENQADAPAGDMPFYGLLDPEEQEYFSRANEVLELNQFQDAEERRIFIDSVYKEANGKELKIACSQGCSRLMEKLISMSDMRQIHRLFNKFIGHFMNLVQHRFASHCCETLFINAAPGVTQKVSKSKSDKMDVDEEEGEEPEPELSLAEMFIKVVEELEGNWGYLLTERFASHTIRVLLLVLAGEPVDVSANDSVVASRKKEKLGLPQGETQDGDVSAQKRSVPDVFEATLKKIMKDIVSVLDDTYLRALATHPVGNPVLQVLVSLELSHFGKSSAKDPNSITRRLIPDESFEEGSETTTFVRGLLYDPVGSRLLETIVRCMPGKAFKGLYKNFIRDQITSLARNITAGYVVLRVLERLGKDDLQNALERIVPQVPSLLERSRMVVPKVLIERCLVRGVDTAPLARALEEAYDKDPARRLEQILRLESTTQEDLEESEQKPKGANAAPSQSSTGEKLHGSLLAQTMLTAPGPISGLIYSSLLAQSSESLVKIAKDPTASRVLQQALTVPTSSAQFRRQFAPRFTSHLKELALDSSGSHVVDALWPATKDIFFIKERMAQELTQHEMALRDSFVGRAVWRNWAMDLYKRRRGEWAMKAKGIDNNNGSGERPKSRIELARAKFAAKAEEDAKKGAQKGVTA

SEQ ID NO: 15448 - DNA, 1968 bp, Schizosaccharomyces pombe
  CDS (1)..(1968)
atgccaaaaaaaagaaaaacgcgtggtaaaaagcactctgccaaacaaaaggaggaagaagttaattcagttgtttctcccggtattgcaaaaaacgatgaaggcgctggaaatgatgaaggtgcatatcaggtaaaccgttacacgaatgaaccagtgcaaccgttttttggtgctttggaccccgaagaagaaaaatacttccaacaagctgaacaggcttttgccaatcattttacaagagaaaacgaagataccaggttttttgtcgacagcatttatcgtgaggtgcaaggcaaagagctaattgtctgcaacaatgtgttcggatcgaaggttcttgaaaagcttttccctttatcaacgagtagacaaatcaaatcgtttttttctgcattgaatggtcattatgtggagctaattcagacaacgtttggctcttatgctttcgaaaagctgttgagtcacatggctgccattctaaatttggaaacccaaggtgttacagaggatcaagatgatgttttggaaggtgaaaatgaaaatgtcttcatgacagcagaaactttacttatgtacatgtacaatgaaatacgcccagaggtttctatgctaatgagccataagttggctgttcatgtattgggcaaaattttccttttgcttgatggatatcgattcgtgtatcatgatggaaacagaaccactatggagtctatttctgttcccgaatcctttccccagtttgcttattccataattgatagtgctacggacaacctcgataccccagaacttcgagcttattgtgttgataaatatgcgagtcaaattatgagagcgtttatacgtatagactttgagcgctcaaaaaaaacaaaaaagaagcacgatccacgcttagtttccaaattgttactatctaacgagtacgatttaaaagaattaccgtttatggaaactttgttgaaggacgaaactggctcgcgtattctggaggtcatcgttgaaaacatgtcagcctctcatctactcagattttatgccgtctttgaaggacgtttttatcggctttgtgttcatcctatagccaattttataatgcaacgttacataagaaggttgggaaggaaggagattggttctgtcattgatgaattaaagaagaatacagacaacatcattaggaagtcatttcttccagtgttaaggacattacttgagaagagtaaccatttacattgttatcaagatgacatattttcaatgattcagacaagcgtaacaaatagtggaaaggatgccaacattattccatgcttgctccgatcgaagcataaacgtgataaagccaacccagaaaacaaagagcgtaaacttgttaataatttactgggtgctcaactgttagaagaaatgcttcactgtgagaaacaacatattcagttattattagatagcgttttagatctctcaaaagagcagattttggaatattgtctggaaacagtatcctctcacttgatagaaggaattcttgatttatcagacttaaacccggtatttcttaaaaaatttctcaatatcctttccggatcatttgctacattagctgtttctgctcctggttcgcatattgtagataaagcgtggaaggccacaagggcattgccgctttatcgtacaagaattgttcgtgagttggctgaaggtggtgacgacgtcaaatttgatttctatggcaaaaaagtttgctcaaactggaaggtcgagctttttcgtcgagctcctgatgaatggtatcgtttcatgaaacaggatgaaccatctaagcgtgttcatgaacgtgcacgccagtatggtcgtattgtttctggcagttcagccaatactcagcctttgggggagaagcgcagcactgaaaatgatgaagagcttgagtccggtcctaaaagagtgaaagtctga

SEQ ID NO: 15449 - protein, 655 aa, Schizosaccharomyces pombe
MPKKRKTRGKKHSAKQKEEEVNSVVSPGIAKNDEGAGNDEGAYQVNRYTNEPVQPFFGALDPEEEKYFQQAEQAFANHFTRENEDTRFFVDSIYREVQGKELIVCNNVFGSKVLEKLFPLSTSRQIKSFFSALNGHYVELIQTTFGSYAFEKLLSHMAAILNLETQGVTEDQDDVLEGENENVFMTAETLLMYMYNEIRPEVSMLMSHKLAVHVLGKIFLLLDGYRFVYHDGNRTTMESISVPESFPQFAYSIIDSATDNLDTPELRAYCVDKYASQIMRAFIRIDFERSKKTKKKHDPRLVSKLLLSNEYDLKELPFMETLLKDETGSRILEVIVENMSASHLLRFYAVFEGRFYRLCVHPIANFIMQRYIRRLGRKEIGSVIDELKKNTDNIIRKSFLPVLRTLLEKSNHLHCYQDDIFSMIQTSVTNSGKDANIIPCLLRSKHKRDKANPENKERKLVNNLLGAQLLEEMLHCEKQHIQLLLDSVLDLSKEQILEYCLETVSSHLIEGILDLSDLNPVFLKKFLNILSGSFATLAVSAPGSHIVDKAWKATRALPLYRTRIVRELAEGGDDVKFDFYGKKVCSNWKVELFRRAPDEWYRFMKQDEPSKRVHERARQYGRIVSGSSANTQPLGEKRSTENDEELESGPKRVKV

SEQ ID NO: 15450 - DNA, 25 bp, Artificial sequence
  primer
atgggaaagactaaaacaagaggca

SEQ ID NO: 15451 - DNA, 27 bp, Artificial sequence
  primer
ttatctatagtgcttttgctttttgaa

SEQ ID NO: 15452 - protein, 720 aa, Artificial sequence
  consensus sequence
  Variant (3)..(7): Xaa in position 3 to 7 is any amino acid
  Variant (9)..(42): Xaa in position 9 to 42 is any amino acid
  Variant (43)..(74): Xaa in position 43 to 74 is any or no amino acid
  Variant (76)..(76): Xaa in position 76 is any amino acid
  Variant (78)..(78): Xaa in position 78 is any amino acid
  Variant (81)..(82): Xaa in position 81 to 82 is any amino acid
  Variant (84)..(85): Xaa in position 84 to 85 is any amino acid
  Variant (88)..(89): Xaa in position 88 to 89 is any amino acid
  Variant (91)..(93): Xaa in position 91 to 93 is any amino acid
  Variant (95)..(98): Xaa in position 95 to 98 is any amino acid
  Variant (100)..(102): Xaa in position 100 to 102 is any amino acid
  Variant (104)..(107): Xaa in position 104 to 107 is any amino acid
  Variant (109)..(114): Xaa in position 109 to 114 is any amino acid
  Variant (116)..(117): Xaa in position 116 to 117 is any amino acid
  Variant (123)..(126): Xaa in position 123 to 126 is any amino acid
  Variant (128)..(129): Xaa in position 128 to 129 is any amino acid
  Variant (131)..(131): Xaa in position 131 is any amino acid
  Variant (133)..(133): Xaa in position 133 is any amino acid
  Variant (135)..(143): Xaa in position 135 to 143 is any amino acid
  Variant (145)..(148): Xaa in position 145 to 148 is any amino acid
  Variant (150)..(151): Xaa in position 150 to 151 is any amino acid
  Variant (153)..(153): Xaa in position 153 is any amino acid
  Variant (155)..(158): Xaa in position 155 to 158 is any amino acid
  Variant (160)..(161): Xaa in position 160 to 161 is any amino acid
  Variant (163)..(165): Xaa in position 163 to 165 is any amino acid
  Variant (168)..(169): Xaa in position 168 to 169 is any amino acid
  Variant (171)..(171): Xaa in position 171 is any amino acid
  Variant (173)..(176): Xaa in position 173 to 176 is any amino acid
  Variant (178)..(182): Xaa in position 178 to 182 is any amino acid
  Variant (184)..(197): Xaa in position 184 to 197 is any amino acid
  Variant (198)..(213): Xaa in position 198 to 213 is any or no amino acid
  Variant (215)..(216): Xaa in position 215 to 216 is any amino acid
  Variant (218)..(222): Xaa in position 218 to 222 is any amino acid
  Variant (224)..(236): Xaa in position 224 to 236 is any amino acid
  Variant (240)..(241): Xaa in position 240 to 241 is any amino acid
  Variant (243)..(245): Xaa in position 243 to 245 is any amino acid
  Variant (247)..(247): Xaa in position 247 is any amino acid
  Variant (249)..(259): Xaa in position 249 to 259 is any amino acid
  Variant (260)..(269): Xaa in position 260 to 269 is any or no amino acid
  Variant (271)..(279): Xaa in position 271 to 279 is any amino acid
  Variant (280)..(292): Xaa in position 280 to 292 is any or no amino acid
  Variant (294)..(295): Xaa in position 294 to 295 is any amino acid
  Variant (297)..(316): Xaa in position 297 to 316 is any amino acid
  Variant (317)..(333): Xaa in position 317 to 333 is any or no amino acid
  Variant (335)..(343): Xaa in position 335 to 343 is any amino acid
  Variant (345)..(346): Xaa in position 345 to 346 is any amino acid
  Variant (348)..(379): Xaa in position 348 to 379 is any amino acid
  Variant (380)..(391): Xaa in position 380 to 391 is any or no amino acid
  Variant (393)..(395): Xaa in position 393 to 395 is any amino acid
  Variant (397)..(398): Xaa in position 397 to 398 is any amino acid
  Variant (400)..(401): Xaa in position 400 to 401 is any amino acid
  Variant (404)..(405): Xaa in position 404 to 405 is any amino acid
  Variant (407)..(421): Xaa in position 407 to 421 is any amino acid
  Variant (422)..(423): Xaa in position 422 to 423 is any or no amino acid
  Variant (425)..(433): Xaa in position 425 to 433 is any amino acid
  Variant (434)..(434): Xaa in position 434 is any or no amino acid
  Variant (436)..(451): Xaa in position 436 to 451 is any amino acid
  Variant (452)..(452): Xaa in position 452 is any or no amino acid
  Variant (454)..(471): Xaa in position 454 to 471 is any amino acid
  Variant (473)..(517): Xaa in position 473 to 517 is any amino acid
  Variant (518)..(531): Xaa in position 518 to 531 is any or no amino acid
  Variant (533)..(590): Xaa in position 533 to 590 is any amino acid
  Variant (591)..(606): Xaa in position 591 to 606 is any or no amino acid
  Variant (608)..(613): Xaa in position 608 to 613 is any amino acid
  Variant (614)..(614): Xaa in position 614 is any or no amino acid
  Variant (616)..(637): Xaa in position 616 to 637 is any amino acid
  Variant (638)..(645): Xaa in position 638 to 645 is any or no amino acid
  Variant (648)..(652): Xaa in position 648 to 652 is any amino acid
  Variant (654)..(656): Xaa in position 654 to 656 is any amino acid
  Variant (658)..(659): Xaa in position 658 to 659 is any amino acid
  Variant (661)..(662): Xaa in position 661 to 662 is any amino acid
  Variant (664)..(676): Xaa in position 664 to 676 is any amino acid
  Variant (677)..(682): Xaa in position 677 to 682 is any or no amino acid
  Variant (684)..(694): Xaa in position 684 to 694 is any amino acid
  Variant (695)..(695): Xaa in position 695 is any or no amino acid
  Variant (697)..(698): Xaa in position 697 to 698 is any amino acid
  Variant (701)..(701): Xaa in position 701 is any amino acid
  Variant (704)..(709): Xaa in position 704 to 709 is any amino acid
  Variant (711)..(714): Xaa in position 711 to 714 is any amino acid
  Variant (716)..(719): Xaa in position 716 to 719 is any amino acid
RGXXXXXKXXXXXXXXXXXXXXXXXXXXXXXXXXXXXXXXXXXXXXXXXXXXXXXXXXXXXXXXXXXXXXXXXXFXGXLDXXEXXYFXXAXXXLXXXXFXXXEXXXXFXXXXXXEXXGKELKXXXXQXXSXLXEXXXXXXXXXQXXXXFXXFXGXXXXLXXHXXXSHXXEXLXXXXAXXXXXEXXXXXXXXXXXXXXXXXXXXXXXXXXXXXXEXXFXXXXXEXXXXXXXXXXXXXASHXXRXXXLXLXXXXXXXXXXXXXXXXXXXXXKXXXXXXXXXXXXXXXXXXXXXXPXXFXXXXXXXXXXXXXXXXXXXXXXXXXXXXXXXXXXXXXRXXXXXXXXXPXXQXXXXXXXXXXXXXXXXXXXXXXXXXXXXXXXXXXXXXXXXXXXXFXXXLXXDXXGSXXLXXXXXXXXXXXXXXXXXYXXXXXXXXXXLXXXXXXXXXXXXXXXXXLXXXXXXXXXXXXXXXXXXLXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXSXXXXXXXLXXXXXXXXXXXXXXXXXXXXXXXXXXXXXXLAXXXXXSXXXDXXWXXTXXXXXXXXXXXXXXXXXXXLXXXXXXXXXXXXGXXVWXNWXXXXXXRXXXXWXXXXK

SEQ ID NO: 15453 - protein, 49 aa, Artificial sequence
  protein pattern
  Variant (2)..(2): Xaa in position 2 is Lys or Arg
  Variant (4)..(4): Xaa in position 4 is Leu or Met
  Variant (6)..(6): Xaa in position 6 is Lys or Arg
  Variant (7)..(7): Xaa in position 7 is Ile, Leu or Val
  Variant (8)..(8): Xaa in position 8 is Ile or Val
  Variant (9)..(10): Xaa in position 9 to 10 is any amino acid
  Variant (11)..(11): Xaa in position 11 is Ala, Cys or Ser
  Variant (12)..(12): Xaa in position 12 is Asp, Asn, Ser or Thr
  Variant (13)..(14): Xaa in position 13 to 14 is any amino acid
  Variant (16)..(16): Xaa in position 16 is any amino acid
  Variant (17)..(17): Xaa in position 17 is His, Lys or Arg
  Variant (18)..(18): Xaa in position 18 is any amino acid
  Variant (19)..(19): Xaa in position 19 is Ile or Leu
  Variant (21)..(22): Xaa in position 21 to 22 is any amino acid
  Variant (24)..(24): Xaa in position 24 is any amino acid
  Variant (26)..(26): Xaa in position 26 is any amino acid
  Variant (27)..(27): Xaa in position 27 is any or no amino acid
  Variant (29)..(32): Xaa in position 29 to 32 is any amino acid
  Variant (33)..(33): Xaa in position 33 is any or no amino acid
  Variant (35)..(35): Xaa in position 35 is Lys or Arg
  Variant (36)..(36): Xaa in position 36 is Phe or Tyr
  Variant (37)..(37): Xaa in position 37 is Ala or Ser
  Variant (40)..(40): Xaa in position 40 is Cys or Val
  Variant (41)..(41): Xaa in position 41 is any amino acid
  Variant (43)..(43): Xaa in position 43 is Ala or Thr
  Variant (45)..(45): Xaa in position 45 is Phe or Leu
  Variant (46)..(46): Xaa in position 46 is Ile, Leu or Val
  Variant (47)..(47): Xaa in position 47 is any amino acid
  Variant (48)..(48): Xaa in position 48 is Ala, Gly or Ser
SXLXEXXXXXXXXXQXXXXFXXFXGXXFXXXXXHXXXSHXXEXLXXXXA

SEQ ID NO: 15454 - protein, 22 aa, Artificial sequence
  protein pattern
  Variant (2)..(2): Xaa in position 2 is Lys or Arg
  Variant (3)..(3): Xaa in position 3 is any amino acid
  Variant (5)..(6): Xaa in position 5 to 6 is any amino acid
  Variant (9)..(9): Xaa in position 9 is any amino acid
  Variant (10)..(11): Xaa in position 10 to 11 is any or no amino acid
  Variant (13)..(14): Xaa in position 13 to 14 is any amino acid
  Variant (15)..(16): Xaa in position 15 to 16 is any or no amino acid
  Variant (18)..(20): Xaa in position 18 to 20 is any amino acid
  Variant (21)..(21): Xaa in position 21 is Asp or Glu
GXXVXXNWXXXLXXXXRXXXXW

SEQ ID NO: 15455 - protein, 19 aa, Artificial sequence
  protein pattern
  Variant (2)..(2): Xaa in position 2 is Phe or Tyr
  Variant (4)..(4): Xaa in position 4 is any amino acid
  Variant (5)..(5): Xaa in position 5 is Leu or Val
  Variant (6)..(6): Xaa in position 6 is Ala or Asp
  Variant (7)..(7): Xaa in position 7 is any amino acid
  Variant (8)..(8): Xaa in position 8 is Asp, Glu, Gly, Asn or Gln
  Variant (10)..(10): Xaa in position 10 is any amino acid
  Variant (11)..(11): Xaa in position 11 is Asp, Glu or Lys
  Variant (14)..(15): Xaa in position 14 to 15 is any amino acid
  Variant (16)..(17): Xaa in position 16 to 17 is any or no amino acid
  Variant (19)..(19): Xaa in position 19 is Asp, Glu, Asn or Thr
FXGXXXXXEXXYFXXXXAX

SEQ ID NO: 15456 - protein, 18 aa, Artificial sequence
  protein pattern
  Variant (2)..(2): Xaa in position 2 is Ala or Ser
  Variant (3)..(3): Xaa in position 3 is any amino acid
  Variant (4)..(4): Xaa in position 4 is Asp, Asn or Ser
  Variant (5)..(6): Xaa in position 5 to 6 is any amino acid
  Variant (7)..(7): Xaa in position 7 is Ala or Gly
  Variant (9)..(9): Xaa in position 9 is His or Arg
  Variant (10)..(10): Xaa in position 10 is Ile or Val
  Variant (11)..(11): Xaa in position 11 is Ile, Met or Val
  Variant (13)..(13): Xaa in position 13 is any amino acid
  Variant (14)..(14): Xaa in position 14 is Ala, Leu or Val
  Variant (16)..(17): Xaa in position 16 to 17 is any or no amino acid
LXXXXXXSXXXDXXWXXT

SEQ ID NO: 15457 - protein, 19 aa, Artificial sequence
  protein pattern
  Variant (2)..(4): Xaa in position 2 to 4 is any or no amino acid
  Variant (6)..(6): Xaa in position 6 is Leu or Val
  Variant (7)..(7): Xaa in position 7 is any amino acid
  Variant (9)..(10): Xaa in position 9 to 10 is any amino acid
  Variant (13)..(13): Xaa in position 13 is His or Arg
  Variant (14)..(14): Xaa in position 14 is Phe, Ile or Leu
  Variant (16)..(16): Xaa in position 16 is Glu or Gln
  Variant (17)..(17): Xaa in position 17 is Asn, Ser, Thr or Val
  Variant (18)..(18): Xaa in position 18 is Ile or Val
  Variant (19)..(19): Xaa in position 19 is Ile, Leu or Val
FXXXLXXDXXGSXXLXXXX

SEQ ID NO: 15458 - protein, 21 aa, Artificial sequence
  protein pattern
  Variant (2)..(3): Xaa in position 2 to 3 is any amino acid
  Variant (4)..(4): Xaa in position 4 is Ala, Cys or Ser
  Variant (5)..(7): Xaa in position 5 to 7 is any amino acid
  Variant (8)..(8): Xaa in position 8 is Ile, Leu or Val
  Variant (9)..(9): Xaa in position 9 is Ala, Gly or Ser
  Variant (10)..(10): Xaa in position 10 is Asn or Ser
  Variant (12)..(12): Xaa in position 12 is Thr or Val
  Variant (13)..(13): Xaa in position 13 is Ile, Leu or Val
  Variant (15)..(15): Xaa in position 15 is any or no amino acid
  Variant (17)..(18): Xaa in position 17 to 18 is any amino acid
  Variant (19)..(20): Xaa in position 19 to 20 is any or no amino acid
RXXXXXXXXXPXXQXLXXXXE

SEQ ID NO: 15459 - protein, 14 aa, Artificial sequence
  protein pattern
  Variant (2)..(2): Xaa in position 2 is Ile, Leu or Val
  Variant (3)..(3): Xaa in position 3 is Ala, Asp, Glu, Asn, Ser or Thr
  Variant (4)..(4): Xaa in position 4 is Gly, Asn or Ser
  Variant (5)..(5): Xaa in position 5 is Ile, Leu or Val
  Variant (6)..(7): Xaa in position 6 to 7 is any amino acid
  Variant (9)..(9): Xaa in position 9 is Ala, Ser or Val
  Variant (10)..(10): Xaa in position 10 is any amino acid
FXXXXXXEXXGKEL

SEQ ID NO: 15460 - DNA, 1650 bp, Saccharomyces cerevisiae
  CDS (1)..(1650)
atgaagaactctgtcggtatttcaattgcaaccattgttgctatcatagcagctatatactatgtgccatggtacgaacactttgagagaaagtcaccgggggccggagaaatgagagatcggattgaaagcatgttcttggaatcgtggagagactattccaagcatggctggggatacgatgtgtatggacctattgagcacacttcccataatatgcctcgtggcaaccagccgttaggctggattatcgtagattcagtggataccttgatgttaatgtataactcctccacactatacaaaagtgagttcgaggcagaaattcagagatcggagcattggataaacgatgttttggattttgatattgatgccgaagtgaatgtttttgaaactactattagaatgctaggtggtttattatccgcatatcatctatctgatgttttagaagtaggtaataagactgtctacttgaacaaagcaatagatttgggggataggcttgctttggcgttcttatccactcagaccggaattccatactcaagtataaaccttcatagtgaccaagcggttaagaaccatgcagatgggggggcatcttctaccgcagaattcactacgctacaaatggaattcaaatatctggcgtatttgacaggaaatcgtacttattgggagctggtggagcgtgtttacgagccattatacaaaaataacgatcttctaaatacctacgatggattggttccaatttatacatttccagatactgggaagtttggtgcttcgactatccggttcggatcaagaggtgattctttttatgagtatttactaaaacaatatttattgacgcacgaaacactttattatgatctgtacagaaaatccatggaaggtatgaaaaagcatttattagcacaatccaaaccctcttctctgtggtacattggggaaagagaacaaggtctacatggacaactttctcctaagatggaccacctcgtgtgctttatggggggattgttagcatcaggctctactgagggcctttctattcatgaagcccgaagacgtccgtttttctctctttcccttgaaagaaaaagtgactgggatttggctaaagggataactgacacatgttatcaaatgtacaagcagtcttcctcggggcttgcgcctgaaatcgttgtcttcaatgatggaaacataaaacaggatggttggtggcggtcgtctgtgggtgatttttttgttaaaccactcgataggcacaacctacaaagaccagaaacggtggaatcgattatgttcatgtatcatttatctcatgatcacaaatatcgtgaatggggggcggaaatcgcaactagcttctttgaaaatacctgtgttgattgtaatgacccaaaattaaggcggttcaccagtttaagtgattgtatcacgttacctacaaagaaatctaacaatatggaaagtttctggttggcagagactttaaagtatttatatatattgtttttagacgagtttgatttgaccaaagttgttttcaacacagaagctcatccttttccagtattagacgaagaaatattaaaatcgcagtctctgaccacaggttggtcgttgtag

SEQ ID NO: 15461 - protein, 549 aa, Saccharomyces cerevisiae
MKNSVGISIATIVAIIAAIYYVPWYEHFERKSPGAGEMRDRIESMFLESWRDYSKHGWGYDVYGPIEHTSHNMPRGNQPLGWIIVDSVDTLMLMYNSSTLYKSEFEAEIQRSEHWINDVLDFDIDAEVNVFETTIRMLGGLLSAYHLSDVLEVGNKTVYLNKAIDLGDRLALAFLSTQTGIPYSSINLHSDQAVKNHADGGASSTAEFTTLQMEFKYLAYLTGNRTYWELVERVYEPLYKNNDLLNTYDGLVPIYTFPDTGKFGASTIRFGSRGDSFYEYLLKQYLLTHETLYYDLYRKSMEGMKKHLLAQSKPSSLWYIGEREQGLHGQLSPKMDHLVCFMGGLLASGSTEGLSIHEARRRPFFSLSLERKSDWDLAKGITDTCYQMYKQSSSGLAPEIVVFNDGNIKQDGWWRSSVGDFFVKPLDRHNLQRPETVESIMFMYHLSHDHKYREWGAEIATSFFENTCVDCNDPKLRRFTSLSDCITLPTKKSNNMESFWLAETLKYLYILFLDEFDLTKVVFNTEAHPFPVLDEEILKSQSLTTGWSL

SEQ ID NO: 15462 - DNA, 2055 bp, Oryza sativa (japonica cultivar-group); identical to SEQ ID NO: 7368
  CDS (1)..(2055)

SEQ ID NO: 15463 - protein, 684 aa, Oryza sativa (japonica cultivar-group); identical to SEQ ID NO: 7369

SEQ ID NO: 15464 - DNA, 1758 bp, Oryza sativa (japonica cultivar-group); identical to SEQ ID NO: 7370
  CDS (1)..(1758)

SEQ ID NO: 15465 - protein, 585 aa, Oryza sativa (japonica cultivar-group); identical to SEQ ID NO: 7371

SEQ ID NO: 15466 - DNA, 1719 bp, Oryza sativa (japonica cultivar-group); identical to SEQ ID NO: 7372
  CDS (1)..(1719)

SEQ ID NO: 15467 - protein, 572 aa, Oryza sativa (japonica cultivar-group); identical to SEQ ID NO: 7373

SEQ ID NO: 15468 - DNA, 1938 bp, Oryza sativa (japonica cultivar-group); identical to SEQ ID NO: 7374
  CDS (1)..(1938)

SEQ ID NO: 15469 - protein, 645 aa, Oryza sativa (japonica cultivar-group); identical to SEQ ID NO: 7375

SEQ ID NO: 15470 - DNA, 1683 bp, Arabidopsis thaliana; identical to SEQ ID NO: 7376
  CDS (1)..(1683)

SEQ ID NO: 15471 - protein, 560 aa, Arabidopsis thaliana; identical to SEQ ID NO: 7377

SEQ ID NO: 15472 - DNA, 1875 bp, Arabidopsis thaliana; identical to SEQ ID NO: 7378
  CDS (1)..(1875)

SEQ ID NO: 15473 - protein, 624 aa, Arabidopsis thaliana; identical to SEQ ID NO: 7379

SEQ ID NO: 15474 - DNA, 1725 bp, Arabidopsis thaliana; identical to SEQ ID NO: 7380
  CDS (1)..(1725)

SEQ ID NO: 15475 - protein, 574 aa, Arabidopsis thaliana; identical to SEQ ID NO: 7381

SEQ ID NO: 15476 - DNA, 1875 bp, Arabidopsis thaliana; identical to SEQ ID NO: 7382
  CDS (1)..(1875)

SEQ ID NO: 15477 - protein, 624 aa, Arabidopsis thaliana; identical to SEQ ID NO: 7383

SEQ ID NO: 15478 - DNA, 1719 bp, Arabidopsis thaliana; identical to SEQ ID NO: 7384
  CDS (1)..(1719)

SEQ ID NO: 15479 - protein, 572 aa, Arabidopsis thaliana; identical to SEQ ID NO: 7385

SEQ ID NO: 15480 - DNA, 1827 bp, Magnaporthe grisea 70-15; identical to SEQ ID NO: 7386
  CDS (1)..(1827)

SEQ ID NO: 15481 - protein, 608 aa, Magnaporthe grisea 70-15; identical to SEQ ID NO: 7387

SEQ ID NO: 15482 - DNA, 1959 bp, Magnaporthe grisea 70-15; identical to SEQ ID NO: 7388
  CDS (1)..(1959)

SEQ ID NO: 15483 - protein, 652 aa, Magnaporthe grisea 70-15; identical to SEQ ID NO: 7389

SEQ ID NO: 15484 - DNA, 1584 bp, Magnaporthe grisea 70-15; identical to SEQ ID NO: 7390
  CDS (1)..(1584)

SEQ ID NO: 15485 - protein, 527 aa, Magnaporthe grisea 70-15; identical to SEQ ID NO: 7391

SEQ ID NO: 15486 - DNA, 1860 bp, Magnaporthe grisea 70-15; identical to SEQ ID NO: 7392
  CDS (1)..(1860)

SEQ ID NO: 15487 - protein, 619 aa, Magnaporthe grisea 70-15; identical to SEQ ID NO: 7393

SEQ ID NO: 15488 - DNA, 2064 bp, Gibberella zeae PH-1; identical to SEQ ID NO: 7394
  CDS (1)..(2064)

SEQ ID NO: 15489 - protein, 687 aa, Gibberella zeae PH-1; identical to SEQ ID NO: 7395

SEQ ID NO: 15490 - DNA, 1845 bp, Gibberella zeae PH-1; identical to SEQ ID NO: 7396
  CDS (1)..(1845)

SEQ ID NO: 15491 - protein, 614 aa, Gibberella zeae PH-1; identical to SEQ ID NO: 7397

SEQ ID NO: 15492 - DNA, 1638 bp, Gibberella zeae PH-1; identical to SEQ ID NO: 7398
  CDS (1)..(1638)

SEQ ID NO: 15493 - protein, 545 aa, Gibberella zeae PH-1; identical to SEQ ID NO: 7399

SEQ ID NO: 15494 - DNA, 1761 bp, Gibberella zeae PH-1; identical to SEQ ID NO: 7400
  CDS (1)..(1761)

SEQ ID NO: 15495 - protein, 586 aa, Gibberella zeae PH-1; identical to SEQ ID NO: 7401

SEQ ID NO: 15496 - DNA, 1644 bp, Candida glabrata CBS 138; identical to SEQ ID NO: 7402
  CDS (1)..(1644)

SEQ ID NO: 15497 - protein, 547 aa, Candida glabrata CBS 138; identical to SEQ ID NO: 7403

SEQ ID NO: 15498 - DNA, 1656 bp, Kluyveromyces lactis NRRL Y-1140; identical to SEQ ID NO: 7404
  CDS (1)..(1656)

SEQ ID NO: 15499 - protein, 551 aa, Kluyveromyces lactis NRRL Y-1140; identical to SEQ ID NO: 7405

SEQ ID NO: 15500 - DNA, 2541 bp, Debaryomyces hansenii CBS767; identical to SEQ ID NO: 7406
  CDS (1)..(2541)

SEQ ID NO: 15501 - protein, 846 aa, Debaryomyces hansenii CBS767; identical to SEQ ID NO: 7407

SEQ ID NO: 15502 - DNA, 1773 bp, Debaryomyces hansenii CBS767; identical to SEQ ID NO: 7408
  CDS (1)..(1773)

SEQ ID NO: 15503 - protein, 590 aa, Debaryomyces hansenii CBS767; identical to SEQ ID NO: 7409

SEQ ID NO: 15504 - DNA, 1890 bp, Yarrowia lipolytica CLIB122; identical to SEQ ID NO: 7410
  CDS (1)..(1890)

SEQ ID NO: 15505 - protein, 629 aa, Yarrowia lipolytica CLIB122; identical to SEQ ID NO: 7411

SEQ ID NO: 15506 - DNA, 2325 bp, Yarrowia lipolytica CLIB122; identical to SEQ ID NO: 7412
  CDS (1)..(2325)

SEQ ID NO: 15507 - protein, 774 aa, Yarrowia lipolytica CLIB122; identical to SEQ ID NO: 7413

SEQ ID NO: 15508 - DNA, 1755 bp, Aspergillus nidulans FGSC A4; identical to SEQ ID NO: 7414
  CDS (1)..(1755)

SEQ ID NO: 15509 - protein, 584 aa, Aspergillus nidulans FGSC A4; identical to SEQ ID NO: 7415

SEQ ID NO: 15510 - DNA, 1761 bp, Aspergillus nidulans FGSC A4; identical to SEQ ID NO: 7416
  CDS (1)..(1761)

SEQ ID NO: 15511 - protein, 586 aa, Aspergillus nidulans FGSC A4; identical to SEQ ID NO: 7417

SEQ ID NO: 15512 - DNA, 2127 bp, Aspergillus nidulans FGSC A4; identical to SEQ ID NO: 7418
  CDS (1)..(2127)

SEQ ID NO: 15513 - protein, 708 aa, Aspergillus nidulans FGSC A4; identical to SEQ ID NO: 7419

SEQ ID NO: 15514 - DNA, 1848 bp, Candida albicans SC5314; identical to SEQ ID NO: 7420
  CDS (1)..(1848): transl_table=12

SEQ ID NO: 15515 - protein, 615 aa, Candida albicans SC5314; identical to SEQ ID NO: 7421

SEQ ID NO: 15516 - DNA, 2061 bp, Ustilago maydis 521; identical to SEQ ID NO: 7422
  CDS (1)..(2061)

SEQ ID NO: 15517 - protein, 686 aa, Ustilago maydis 521; identical to SEQ ID NO: 7423

SEQ ID NO: 15518 - DNA, 3429 bp, Ustilago maydis 521; identical to SEQ ID NO: 7424
  CDS (1)..(3429)

SEQ ID NO: 15519 - protein, 1142 aa, Ustilago maydis 521; identical to SEQ ID NO: 7425

SEQ ID NO: 15520 - DNA, 2595 bp, Cryptococcus neoformans var. neoformans B-3501A; identical to SEQ ID NO: 7426
  CDS (1)..(2595)

SEQ ID NO: 15521 - protein, 864 aa, Cryptococcus neoformans var. neoformans B-3501A; identical to SEQ ID NO: 7427

SEQ ID NO: 15522 - DNA, 1812 bp, Cryptococcus neoformans var. neoformans B-3501A; identical to SEQ ID NO: 7428
  CDS (1)..(1812)

SEQ ID NO: 15523 - protein, 603 aa, Cryptococcus neoformans var. neoformans B-3501A; identical to SEQ ID NO: 7429

SEQ ID NO: 15524 - DNA, 1494 bp, Ostreococcus tauri; identical to SEQ ID NO: 7430
  CDS (1)..(1494)

SEQ ID NO: 15525 - protein, 497 aa, Ostreococcus tauri; identical to SEQ ID NO: 7431

SEQ ID NO: 15526 - DNA, 1914 bp, Phaeosphaeria nodorum; identical to SEQ ID NO: 7432
  CDS (1)..(1914)

SEQ ID NO: 15527 - protein, 637 aa, Phaeosphaeria nodorum; identical to SEQ ID NO: 7433

SEQ ID NO: 15528 - DNA, 2769 bp, Phaeosphaeria nodorum; identical to SEQ ID NO: 7434
  CDS (1)..(2769)

SEQ ID NO: 15529 - protein, 922 aa, Phaeosphaeria nodorum; identical to SEQ ID NO: 7435

SEQ ID NO: 15530 - DNA, 1839 bp, Phaeosphaeria nodorum; identical to SEQ ID NO: 7436
  CDS (1)..(1839)

SEQ ID NO: 15531 - protein, 612 aa, Phaeosphaeria nodorum; identical to SEQ ID NO: 7437

SEQ ID NO: 15532 - DNA, 2142 bp, Phaeosphaeria nodorum; identical to SEQ ID NO: 7438
  CDS (1)..(2142)

SEQ ID NO: 15533 - protein, 713 aa, Phaeosphaeria nodorum; identical to SEQ ID NO: 7439

SEQ ID NO: 15534 - DNA, 1713 bp, Medicago truncatula; identical to SEQ ID NO: 7440
  CDS (1)..(1713)

SEQ ID NO: 15535 - protein, 570 aa, Medicago truncatula; identical to SEQ ID NO: 7441

SEQ ID NO: 15536 - DNA, 1776 bp, Aspergillus fumigatus; identical to SEQ ID NO: 7442
  CDS (1)..(1776)

SEQ ID NO: 15537 - protein, 591 aa, Aspergillus fumigatus; identical to SEQ ID NO: 7443

SEQ ID NO: 15538 - DNA, 2031 bp, Oryza sativa subsp; identical to SEQ ID NO: 7444
  CDS (1)..(2031)

SEQ ID NO: 15539 - protein, 676 aa, Oryza sativa subsp; identical to SEQ ID NO: 7445

SEQ ID NO: 15540 - DNA, 2106 bp, Oryza sativa subsp; identical to SEQ ID NO: 7446
  CDS (1)..(2106)

SEQ ID NO: 15541 - protein, 701 aa, Oryza sativa subsp; identical to SEQ ID NO: 7447

SEQ ID NO: 15542 - DNA, 1936 bp, Arabidopsis thaliana; identical to SEQ ID NO: 7448
  CDS (83)..(1801)

SEQ ID NO: 15543 - protein, 572 aa, Arabidopsis thaliana; identical to SEQ ID NO: 7449

SEQ ID NO: 15544 - DNA, 2138 bp, Arabidopsis thaliana; identical to SEQ ID NO: 7450
  CDS (190)..(1875)

SEQ ID NO: 15545 - protein, 561 aa, Arabidopsis thaliana; identical to SEQ ID NO: 7451

SEQ ID NO: 15546 - DNA, 1878 bp, Ophiostoma novo; identical to SEQ ID NO: 7452
  CDS (1)..(1878)

SEQ ID NO: 15547 - protein, 625 aa, Ophiostoma novo; identical to SEQ ID NO: 7453

SEQ ID NO: 15548 - DNA, 2150 bp, Trichoderma reesei; identical to SEQ ID NO: 7454
  CDS (333)..(1904)

SEQ ID NO: 15549 - protein, 523 aa, Trichoderma reesei; identical to SEQ ID NO: 7455

SEQ ID NO: 15550 - DNA, 2528 bp, Glycine max; identical to SEQ ID NO: 7456
  CDS (338)..(2074)

SEQ ID NO: 15551 - protein, 578 aa, Glycine max; identical to SEQ ID NO: 7457

SEQ ID NO: 15552 - DNA, 1566 bp, Schizosaccharomyces pombe; identical to SEQ ID NO: 7458
  CDS (1)..(1566)

SEQ ID NO: 15553 - protein, 521 aa, Schizosaccharomyces pombe; identical to SEQ ID NO: 7459

SEQ ID NO: 15554 - DNA, 1650 bp, Saccharomyces cerevisiae; identical to SEQ ID NO: 7366
  CDS (1)..(1650)

SEQ ID NO: 15555 - protein, 549 aa, Saccharomyces cerevisiae; identical to SEQ ID NO: 7367

SEQ ID NO: 15556 - DNA, 1698 bp, Zea mays; identical to SEQ ID NO: 7460
  CDS (1)..(1698)

SEQ ID NO: 15557 - protein, 565 aa, Zea mays; identical to SEQ ID NO: 7461

SEQ ID NO: 15558 - DNA, 2016 bp, Hordeum vulgare; identical to SEQ ID NO: 7462
  CDS (1)..(2016)

SEQ ID NO: 15559 - protein, 671 aa, Hordeum vulgare; identical to SEQ ID NO: 7463

SEQ ID NO: 15560 - DNA, 1956 bp, Zea mays; identical to SEQ ID NO: 7464
  CDS (1)..(1956)

SEQ ID NO: 15561 - protein, 651 aa, Zea mays; identical to SEQ ID NO: 7465

SEQ ID NO: 15562 - DNA, 1815 bp, Zea mays; identical to SEQ ID NO: 7466
  CDS (1)..(1815)

SEQ ID NO: 15563 - protein, 604 aa, Zea mays; identical to SEQ ID NO: 7467

SEQ ID NO: 15564 - DNA, 25 bp, Artificial sequence
  primer
atgaagaactctgtcggtatttcaa

SEQ ID NO: 15565 - DNA, 23 bp, Artificial sequence
  primer
ctacaacgaccaacctgtggtca

SEQ ID NO: 15566 - protein, 919 aa, Artificial sequence; identical to SEQ ID NO: 7470
  consensus sequence
  Variant (2)..(4): Xaa in position 2 to 4 is any amino acid
  Variant (6)..(8): Xaa in position 6 to 8 is any amino acid
  Variant (10)..(11): Xaa in position 10 to 11 is any amino acid
  Variant (13)..(15): Xaa in position 13 to 15 is any amino acid
  Variant (17)..(19): Xaa in position 17 to 19 is any amino acid
  Variant (21)..(23): Xaa in position 21 to 23 is any amino acid
  Variant (25)..(34): Xaa in position 25 to 34 is any amino acid
  Variant (35)..(49): Xaa in position 35 to 49 is any or no amino acid
  Variant (51)..(56): Xaa in position 51 to 56 is any amino acid
  Variant (58)..(58): Xaa in position 58 is any amino acid
  Variant (62)..(64): Xaa in position 62 to 64 is any amino acid
  Variant (66)..(92): Xaa in position 66 to 92 is any amino acid
  Variant (93)..(119): Xaa in position 93 to 119 is any or no amino acid
  Variant (123)..(123): Xaa in position 123 is any amino acid
  Variant (126)..(126): Xaa in position 126 is any amino acid
  Variant (134)..(135): Xaa in position 134 to 135 is any amino acid
  Variant (137)..(140): Xaa in position 137 to 140 is any amino acid
  Variant (141)..(165): Xaa in position 141 to 165 is any or no amino acid
  Variant (167)..(168): Xaa in position 167 to 168 is any amino acid
  Variant (170)..(171): Xaa in position 170 to 171 is any amino acid
  Variant (173)..(175): Xaa in position 173 to 175 is any amino acid
  Variant (177)..(178): Xaa in position 177 to 178 is any amino acid
  Variant (180)..(186): Xaa in position 180 to 186 is any amino acid
  Variant (187)..(187): Xaa in position 187 is any or no amino acid
  Variant (189)..(207): Xaa in position 189 to 207 is any amino acid
  Variant (208)..(237): Xaa in position 208 to 237 is any or no amino acid
  Variant (239)..(244): Xaa in position 239 to 244 is any amino acid
  Variant (247)..(249): Xaa in position 247 to 249 is any amino acid
  Variant (251)..(253): Xaa in position 251 to 253 is any amino acid
  Variant (256)..(278): Xaa in position 256 to 278 is any amino acid
  Variant (279)..(283): Xaa in position 279 to 283 is any or no amino acid
  Variant (285)..(294): Xaa in position 285 to 294 is any amino acid
  Variant (295)..(433): Xaa in position 295 to 433 is any or no amino acid
  Variant (435)..(437): Xaa in position 435 to 437 is any amino acid
  Variant (440)..(440): Xaa in position 440 is any amino acid
  Variant (443)..(450): Xaa in position 443 to 450 is any amino acid
  Variant (453)..(453): Xaa in position 453 is any amino acid
  Variant (455)..(459): Xaa in position 455 to 459 is any amino acid
  Variant (460)..(469): Xaa in position 460 to 469 is any or no amino acid
  Variant (471)..(508): Xaa in position 471 to 508 is any amino acid
  Variant (509)..(527): Xaa in position 509 to 527 is any or no amino acid
  Variant (529)..(530): Xaa in position 529 to 530 is any amino acid
  Variant (532)..(533): Xaa in position 532 to 533 is any amino acid
  Variant (535)..(537): Xaa in position 535 to 537 is any amino acid
  Variant (539)..(552): Xaa in position 539 to 552 is any amino acid
  Variant (553)..(585): Xaa in position 553 to 585 is any or no amino acid
  Variant (587)..(590): Xaa in position 587 to 590 is any amino acid
  Variant (591)..(592): Xaa in position 591 to 592 is any or no amino acid
  Variant (594)..(595): Xaa in position 594 to 595 is any amino acid
  Variant (598)..(615): Xaa in position 598 to 615 is any amino acid
  Variant (616)..(770): Xaa in position 616 to 770 is any or no amino acid
  Variant (774)..(775): Xaa in position 774 to 775 is any amino acid
  Variant (778)..(784): Xaa in position 778 to 784 is any amino acid
  Variant (786)..(815): Xaa in position 786 to 815 is any amino acid
  Variant (816)..(844): Xaa in position 816 to 844 is any or no amino acid
  Variant (847)..(848): Xaa in position 847 to 848 is any amino acid
  Variant (849)..(875): Xaa in position 849 to 875 is any or no amino acid
  Variant (877)..(877): Xaa in position 877 is any amino acid
  Variant (880)..(880): Xaa in position 880 is any amino acid
  Variant (881)..(882): Xaa in position 881 to 882 is any or no amino acid
  Variant (885)..(885): Xaa in position 885 is any amino acid
  Variant (888)..(889): Xaa in position 888 to 889 is any amino acid
  Variant (891)..(891): Xaa in position 891 is any amino acid
  Variant (893)..(900): Xaa in position 893 to 900 is any amino acid
  Variant (901)..(914): Xaa in position 901 to 914 is any or no amino acid
  Variant (917)..(917): Xaa in position 917 is any amino acid

SEQ ID NO: 15567 - protein, 17 aa, Artificial sequence
  protein pattern
  Variant (4)..(4): Xaa in position 4 is Cys, Asn or Thr
  Variant (7)..(7): Xaa in position 7 is any amino acid
  Variant (8)..(8): Xaa in position 8 is Leu, Met or Val
  Variant (12)..(16): Xaa in position 12 to 16 is any or no amino acid
FETXIRXXGGLXXXXXL

SEQ ID NO: 15568 - protein, 19 aa, Artificial sequence
  protein pattern
  Variant (2)..(2): Xaa in position 2 is Ala, Glu or Gln
  Variant (3)..(3): Xaa in position 3 is Ser or Thr
  Variant (5)..(6): Xaa in position 5 to 6 is any amino acid
  Variant (7)..(7): Xaa in position 7 is Ala, Gly or Ser
  Variant (9)..(9): Xaa in position 9 is Ala or Thr
  Variant (10)..(10): Xaa in position 10 is Phe, Ile, Leu or Val
  Variant (12)..(14): Xaa in position 12 to 14 is any amino acid
  Variant (15)..(18): Xaa in position 15 to 18 is any or no amino acid
MXXFXXXEXXKXXXXXXXL

SEQ ID NO: 15569 - protein, 19 aa, Artificial sequence
  protein pattern
  Variant (2)..(2): Xaa in position 2 is any or no amino acid
  Variant (6)..(6): Xaa in position 6 is any amino acid
  Variant (7)..(7): Xaa in position 7 is Ile or Val
  Variant (10)..(13): Xaa in position 10 to 13 is any amino acid
  Variant (14)..(14): Xaa in position 14 is Phe, Trp or Tyr
  Variant (15)..(16): Xaa in position 15 to 16 is any amino acid
  Variant (17)..(17): Xaa in position 17 is Ser or Thr
  Variant (18)..(18): Xaa in position 18 is any amino acid
  Variant (19)..(19): Xaa in position 19 is Asp or Asn
LXRPEXXESXXXXXXXXXX

SEQ ID NO: 15570 - protein, 13 aa, Artificial sequence
  protein pattern
  Variant (2)..(2): Xaa in position 2 is Ala, Gly, Ser or Thr
  Variant (3)..(4): Xaa in position 3 to 4 is any amino acid
  Variant (7)..(7): Xaa in position 7 is any amino acid
  Variant (12)..(12): Xaa in position 12 is Ile, Leu or Pro
GXXXDSXYEYLXK

SEQ ID NO: 15571 - DNA, 1764 bp, Saccharomyces cerevisiae
  CDS (1)..(1764)
atggacaagtatttgaattcatttgttgaccacctttcagagtggtcatctcgtgcctttaggaacaattcatcaagcgctaaccaaagtgcgtcgaacaaggaattagaacaagtttttgaacagatcaatgctatagttgaaaaccacaataacaaattaaccactgcctttgataagatatcatatcgcgttgctcacaagattacacacttggtggaaagccattctttagtattcaactacgccactttagttctcatcgcaagtgctttggtcgttattggctcatttacgtctatttcttctattccatttacagctctacctcctacgagagaacactcattgtttgatcctacagattttgatgtggaccacgactgtcatgttatctaccgcgagaatgacgaagataaaaagaaaaagaagaaaagcaagaggtttttcgatatgatggatgaaaaacatgcgattatactgcccttaactagtggctgtactttactcgctctctattttgtgatcaagaaactacacctaaactggctaaaatatgtggtgaaaattttgaattttaatataacactgctaaatatcccagctggcacatttgtctactcctactttctcaactcacttttcagaaacctatcacatttagcttcttggaatcccctggttgttttaccaaggtatcgtgtaacaatagctgatgataacgaagacctgaacaagataggcgggtttgttaccaatttgaattacaaagatggattgaccaactcagttgttcacaagaaaacattggatgagattgaaaaagatcattggatgaagcatttttacagaagagaattagttgaaccgaaggatattaaatcgaagaggcagatcagcaacatgtatttgaatagcgcattaattgtttcgttcgttctgtccatcgtttctaccgtatatttctatttatcacccaatgattggttaatatccaatgctgtcagtatgaatatggctatttggtccattgctcaattaaaattgaagaatttaaaatcaggggccctaatcctaattgctctatttttttacgacatttgctttgtctttggtaccgatgtaatggttacagtagctactaaccttgatattcccgtaaaactaagcttaccagtcaagtttaatacagctcaaaacaacttcaatttttcaatacttggtctgggtgatattgccttgcctggtatgtttattgcgatgtgctacaaatatgacatctggaagtggcaccttgatcatgatgacactgaattccactttttgaactggtcatacgttggaaaatattttattactgctatggttagttacgttgcttctttggtatctgccatggtctccttgtccattttcaatactgctcaaccggctttattatacattgttccttcctttttgattagtactattttggtagcttgctggaacaaggattttaagcagttttggaattttcagtatgatacgattgaagtggataaaagtttaaaaaaagcgatagaaaaaaaggagaactctataacttattcgaccttcatcctatcagaatactataatgatgccgacaagtatgccttgcttggtgatgatgtaaacgaaaattttgacgatgatgaagaattcgtgcaagaggaagatctcagtgacagctctgaggaagagctttctgaagaagatctcttggatgacgaatcttcttga

SEQ ID NO: 15572 - protein, 587 aa, Saccharomyces cerevisiae
MDKYLNSFVDHLSEWSSRAFRNNSSSANQSASNKELEQVFEQINAIVENHNNKLTTAFDKISYRVAHKITHLVESHSLVFNYATLVLIASALVVIGSFTSISSIPFTALPPTREHSLFDPTDFDVDHDCHVIYRENDEDKKKKKKSKRFFDMMDEKHAIILPLTSGCTLLALYFVIKKLHLNWLKYVVKILNFNITLLNIPAGTFVYSYFLNSLFRNLSHLASWNPLVVLPRYRVTIADDNEDLNKIGGFVTNLNYKDGLTNSVVHKKTLDEIEKDHWMKHFYRRELVEPKDIKSKRQISNMYLNSALIVSFVLSIVSTVYFYLSPNDWLISNAVSMNMAIWSIAQLKLKNLKSGALILIALFFYDICFVFGTDVMVTVATNLDIPVKLSLPVKFNTAQNNFNFSILGLGDIALPGMFIAMCYKYDIWKWHLDHDDTEFHFLNWSYVGKYFITAMVSYVASLVSAMVSLSIFNTAQPALLYIVPSFLISTILVACWNKDFKQFWNFQYDTIEVDKSLKKAIEKKENSITYSTFILSEYYNDADKYALLGDDVNENFDDDEEFVQEEDLSDSSEEELSEEDLLDDESS

SEQ ID NO: 15573 - DNA, 1701 bp, Gibberella zeae PH-1; identical to SEQ ID NO: 7663
  CDS (1)..(1701)

SEQ ID NO: 15574 - protein, 566 aa, Gibberella zeae PH-1; identical to SEQ ID NO: 7664

SEQ ID NO: 15575 - DNA, 1698 bp, Candida glabrata CBS 138; identical to SEQ ID NO: 7665
  CDS (1)..(1698)

SEQ ID NO: 15576 - protein, 565 aa, Candida glabrata CBS 138; identical to SEQ ID NO: 7666

SEQ ID NO: 15577 - DNA, 1749 bp, Debaryomyces hansenii CBS767; identical to SEQ ID NO: 7667
  CDS (1)..(1749)

SEQ ID NO: 15578 - protein, 582 aa, Debaryomyces hansenii CBS767; identical to SEQ ID NO: 7668

SEQ ID NO: 15579 - DNA, 1764 bp, Saccharomyces cerevisiae; identical to SEQ ID NO: 7661
  CDS (1)..(1764)

SEQ ID NO: 15580 - protein, 587 aa, Saccharomyces cerevisiae; identical to SEQ ID NO: 7662

SEQ ID NO: 15581 - DNA, 27 bp, Artificial sequence
  primer
atggacaagtatttgaattcatttgtt

SEQ ID NO: 15582 - DNA, 25 bp, Artificial sequence
  primer
tcaagaagattcgtcatccaagaga

SEQ ID NO: 15583 - protein, 495 aa, Artificial sequence; identical to SEQ ID NO: 7671
  consensus sequence
  Variant (2)..(7): Xaa in position 2 to 7 is any amino acid
  Variant (9)..(48): Xaa in position 9 to 48 is any amino acid
  Variant (49)..(74): Xaa in position 49 to 74 is any or no amino acid
  Variant (77)..(81): Xaa in position 77 to 81 is any amino acid
  Variant (83)..(84): Xaa in position 83 to 84 is any amino acid
  Variant (87)..(100): Xaa in position 87 to 100 is any amino acid
  Variant (101)..(103): Xaa in position 101 to 103 is any or no amino acid
  Variant (105)..(119): Xaa in position 105 to 119 is any amino acid
  Variant (121)..(146): Xaa in position 121 to 146 is any amino acid
  Variant (147)..(148): Xaa in position 147 to 148 is any or no amino acid
  Variant (150)..(266): Xaa in position 150 to 266 is any amino acid
  Variant (267)..(271): Xaa in position 267 to 271 is any or no amino acid
  Variant (273)..(274): Xaa in position 273 to 274 is any amino acid
  Variant (281)..(282): Xaa in position 281 to 282 is any amino acid
  Variant (285)..(288): Xaa in position 285 to 288 is any amino acid
  Variant (295)..(295): Xaa in position 295 is any amino acid
  Variant (297)..(298): Xaa in position 297 to 298 is any amino acid
  Variant (300)..(300): Xaa in position 300 is any amino acid
  Variant (302)..(310): Xaa in position 302 to 310 is any amino acid
  Variant (311)..(333): Xaa in position 311 to 333 is any or no amino acid
  Variant (335)..(335): Xaa in position 335 is any amino acid
  Variant (341)..(343): Xaa in position 341 to 343 is any amino acid
  Variant (346)..(348): Xaa in position 346 to 348 is any amino acid
  Variant (350)..(354): Xaa in position 350 to 354 is any amino acid
  Variant (356)..(376): Xaa in position 356 to 376 is any amino acid
  Variant (377)..(435): Xaa in position 377 to 435 is any or no amino acid
  Variant (438)..(443): Xaa in position 438 to 443 is any amino acid
  Variant (445)..(454): Xaa in position 445 to 454 is any amino acid
  Variant (456)..(461): Xaa in position 456 to 461 is any amino acid
  Variant (468)..(468): Xaa in position 468 is any amino acid
  Variant (471)..(494): Xaa in position 471 to 494 is any amino acid

SEQ ID NO: 15584 - protein, 28 aa, Artificial sequence
  protein pattern
  Variant (2)..(2): Xaa in position 2 is Phe or Ile
  Variant (8)..(8): Xaa in position 8 is any or no amino acid
  Variant (10)..(10): Xaa in position 10 is any amino acid
  Variant (11)..(11): Xaa in position 11 is any or no amino acid
  Variant (14)..(14): Xaa in position 14 is any amino acid
  Variant (15)..(15): Xaa in position 15 is Phe or Val
  Variant (16)..(16): Xaa in position 16 is Ile, Met or Val
  Variant (18)..(18): Xaa in position 18 is Leu or Met
  Variant (19)..(19): Xaa in position 19 is Ala or Cys
  Variant (20)..(20): Xaa in position 20 is any amino acid
  Variant (21)..(21): Xaa in position 21 is Lys or Arg
  Variant (22)..(22): Xaa in position 22 is Phe or Tyr
  Variant (24)..(26): Xaa in position 24 to 26 is any amino acid
  Variant (27)..(27): Xaa in position 27 is any or no amino acid
SXLGLGDXIXXPGXXXAXXXXXDXXXXH

SEQ ID NO: 15585 - protein, 56 aa, Artificial sequence; identical to SEQ ID NO: 7673
  protein pattern
  Variant (2)..(3): Xaa in position 2 to 3 is any amino acid
  Variant (4)..(4): Xaa in position 4 is Gly, Ile or Val
  Variant (5)..(5): Xaa in position 5 is Phe, Trp or Tyr
  Variant (6)..(6): Xaa in position 6 is Ala, Gly, Ser or Thr
  Variant (7)..(7): Xaa in position 7 is Ile or Met
  Variant (8)..(8): Xaa in position 8 is Ala, Cys, Asn or Ser
  Variant (9)..(11): Xaa in position 9 to 11 is any amino acid
  Variant (12)..(12): Xaa in position 12 is Ile or Leu
  Variant (13)..(14): Xaa in position 13 to 14 is any amino acid
  Variant (15)..(15): Xaa in position 15 is Phe, Ile or Leu
  Variant (16)..(17): Xaa in position 16 to 17 is any amino acid
  Variant (18)..(18): Xaa in position 18 is Ala, Gly or Thr
  Variant (19)..(19): Xaa in position 19 is any amino acid
  Variant (20)..(20): Xaa in position 20 is Phe, Ile, Leu or Met
  Variant (21)..(21): Xaa in position 21 is Ile or Leu
  Variant (22)..(23): Xaa in position 22 to 23 is any amino acid
  Variant (24)..(24): Xaa in position 24 is Ala, Gly, Thr or Val
  Variant (26)..(30): Xaa in position 26 to 30 is any or no amino acid
  Variant (36)..(36): Xaa in position 36 is any amino acid
  Variant (37)..(37): Xaa in position 37 is Phe or Met
  Variant (40)..(40): Xaa in position 40 is any amino acid
  Variant (41)..(41): Xaa in position 41 is Asn or Thr
  Variant (42)..(43): Xaa in position 42 to 43 is any amino acid
  Variant (50)..(50): Xaa in position 50 is any amino acid
  Variant (52)..(52): Xaa in position 52 is Asp or Glu
  Variant (53)..(53): Xaa in position 53 is Ile, Leu or Val
  Variant (55)..(55): Xaa in position 55 is Phe, Ile or Val

SEQ ID NO: 15586 - protein, 59 aa, Artificial sequence; identical to SEQ ID NO: 7674
  protein pattern
  Variant (3)..(3): Xaa in position 3 is any amino acid
  Variant (4)..(4): Xaa in position 4 is Ala, Thr or Val
  Variant (5)..(5): Xaa in position 5 is Ala or Ser
  Variant (6)..(6): Xaa in position 6 is Ile, Leu, Met or Val
  Variant (7)..(7): Xaa in position 7 is Ala, Ile or Val
  Variant (8)..(8): Xaa in position 8 is Gly or Ser
  Variant (10)..(10): Xaa in position 10 is any amino acid
  Variant (11)..(11): Xaa in position 11 is Ala, Ile or Leu
  Variant (12)..(12): Xaa in position 12 is Gly or Ser
  Variant (13)..(13): Xaa in position 13 is Leu or Met
  Variant (14)..(15): Xaa in position 14 to 15 is any amino acid
  Variant (16)..(16): Xaa in position 16 is Ala, Cys or Thr
  Variant (17)..(17): Xaa in position 17 is Leu, Met or Val
  Variant (18)..(19): Xaa in position 18 to 19 is any amino acid
  Variant (21)..(21): Xaa in position 21 is any amino acid
  Variant (22)..(22): Xaa in position 22 is Ile or Val
  Variant (23)..(23): Xaa in position 23 is Phe or Tyr
  Variant (24)..(25): Xaa in position 24 to 25 is any amino acid
  Variant (26)..(26): Xaa in position 26 is Ala or Gly
  Variant (33)..(33): Xaa in position 33 is Ile or Leu
  Variant (36)..(36): Xaa in position 36 is any amino acid
  Variant (37)..(37): Xaa in position 37 is any or no amino acid
  Variant (39)..(39): Xaa in position 39 is Gly, Ile or Leu
  Variant (40)..(44): Xaa in position 40 to 44 is any amino acid
  Variant (45)..(45): Xaa in position 45 is Ala, Gly, Leu or Val
  Variant (46)..(58): Xaa in position 46 to 58 is any amino acid
  Variant (59)..(59): Xaa in position 59 is Glu, Gln or Ser

SEQ ID NO: 15587 - DNA, 336 bp, Saccharomyces cerevisiae
  CDS (1)..(336)
atgagaaaaatagctcgtcttctcaactgggtatctattgacctcttaattctggttgaatgttttcatcagaaaggtcttcttcatcatcggctttccctattagtccagcaacatcttcttcatcgtgatgaggttggctatgatggttattatgatgagttgtgttcttattatactgcgattctacatccacgtccaccattacatcgtctacgtcatcatcattattctggtgtagattctctacctctttcaaatgcgatgacagtaaccttaactgttccgccacttcatgtggtagtttgtcgtcttcatttctctcttccagtgtga

SEQ ID NO: 15588 - protein, 111 aa, Saccharomyces cerevisiae
MRKIARLLNWVSIDLLILVECFHQKGLLHHRLSLLVQQHLLHRDEVGYDGYYDELCSYYTAILHPRPPLHRLRHHHYSGVDSLPLSNAMTVTLTVPPLHVVVCRLHFSLPV

SEQ ID NO: 15589 - DNA, 336 bp, Saccharomyces pastorianus
  CDS (1)..(336)
atgagaaaaatagctcgtcttctcaactgggtatctattgacctcttaattctggttgaatgttttcatcagaaaggtcttcttcatcatcggctttccctattagtccagcaacatcttcttcatcgtgatgaggttggctatgatggttattatgatgagttgtgttcttattatactgcgattctacatccacgtccaccattacatcgtctacgtcatcatcattattctggtgtagattctctacctctttcaaatgcgatgacagtaaccttaactgttccgccacatcatgtggtagtttgtcgtcttcatttctctcttccagtgtga

SEQ ID NO: 15590 - protein, 111 aa, Saccharomyces pastorianus
MRKIARLLNWVSIDLLILVECFHQKGLLHHRLSLLVQQHLLHRDEVGYDGYYDELCSYYTAILHPRPPLHRLRHHHYSGVDSLPLSNAMTVTLTVPPHHVVVCRLHFSLPV

SEQ ID NO: 15591 - DNA, 25 bp, Artificial sequence
  primer
atgagaaaaatagctcgtcttctca

SEQ ID NO: 15592 - DNA, 25 bp, Artificial sequence
  primer
tcacactggaagagagaaatgaaga

SEQ ID NO: 15593 - DNA, 1017 bp, Saccharomyces cerevisiae
  CDS (1)..(1017)
atggataagaattcagttaacaaagatagtgaagaaaaagacgaaggacacaagattgaggttgtagacgatacaaatcctgacttcatcactgcagattcggaactgacacaagatctgcctgatgatgtagaggttattgacttggtccatctaaaaatcaaatcgttagaagatttgaacctttataggttcaagaatttgaaacaattatgtctcagacagaacctgatcgaaagcataagcgaagtggaagttttaccccatgacaagattgttgaccttgatttttacgataacaaaattaaacatatctcctctaatgttaataagctcaccaaattaacgtctctagacctgtcgtttaacaagatcaagcacatcaaaaatctagaaaatttgactgatctggagaatttatacttcgtgcagaacagcatttccaaaattgaaaatctgtccactttgaaatcactgaaaaacttagaattaggtggtaataaggttcattctattgaacccgattccttcgaaggtctgtcaaacttggaagaaatttggttgggtaaaaattccataccaagacttattaacttacatcctttaaagaatttgaagatattgtccatccaatctaataaattaaaaaaaattgaaaatctagaagagttgaccaatcttgaagagctctatctgtcacataatttcatcaccaagattgaaggtctagagaaaaacctaaaactaactactttggacgtgacctccaacaaaattacctccctggaaaacttgaaccacctgtcaaatttaactgacatatgggcctcctttaacaagatagatcaatcctttgagagcttgggtgaaaacctgtccgccctatcacgcttggagaccatttatctggagggaaaccctattcaactggaaaataagacttcgtatagaagaaaactgactatgaacttacctccatccctacagaagattgatgcgacatatataagaggctga

SEQ ID NO: 15594 - protein, 338 aa, Saccharomyces cerevisiae
MDKNSVNKDSEEKDEGHKIEVVDDTNPDFITADSELTQDLPDDVEVIDLVHLKIKSLEDLNLYRFKNLKQLCLRQNLIESISEVEVLPHDKIVDLDFYDNKIKHISSNVNKLTKLTSLDLSFNKIKHIKNLENLTDLENLYFVQNSISKIENLSTLKSLKNLELGGNKVHSIEPDSFEGLSNLEEIWLGKNSIPRLINLHPLKNLKILSIQSNKLKKIENLEELTNLEELYLSHNFITKIEGLEKNLKLTTLDVTSNKITSLENLNHLSNLTDIWASFNKIDQSFESLGENLSALSRLETIYLEGNPIQLENKTSYRRKLTMNLPPSLQKIDATYIRG

SEQ ID NO: 15595 - DNA, 1105 bp, Saccharomyces cerevisiae; identical to SEQ ID NO: 7780
  CDS (41)..(1057)

SEQ ID NO: 15596 - protein, 338 aa, Saccharomyces cerevisiae; identical to SEQ ID NO: 7781

SEQ ID NO: 15597 - DNA, 1002 bp, Oryza sativa (japonica cultivar-group); identical to SEQ ID NO: 7782
  CDS (1)..(1002)

SEQ ID NO: 15598 - protein, 333 aa, Oryza sativa (japonica cultivar-group); identical to SEQ ID NO: 7783

SEQ ID NO: 15599 - DNA, 987 bp, Arabidopsis thaliana; identical to SEQ ID NO: 7784
  CDS (1)..(987)

SEQ ID NO: 15600 - protein, 328 aa, Arabidopsis thaliana; identical to SEQ ID NO: 7785

SEQ ID NO: 15601 - DNA, 1146 bp, Magnaporthe grisea 70-15; identical to SEQ ID NO: 7786
  CDS (1)..(1146)

SEQ ID NO: 15602 - protein, 381 aa, Magnaporthe grisea 70-15; identical to SEQ ID NO: 7787

SEQ ID NO: 15603 - DNA, 1137 bp, Gibberella zeae PH-1; identical to SEQ ID NO: 7788
  CDS (1)..(1137)

SEQ ID NO: 15604 - protein, 378 aa, Gibberella zeae PH-1; identical to SEQ ID NO: 7789

SEQ ID NO: 15605 - DNA, 1020 bp, Candida glabrata CBS 138; identical to SEQ ID NO: 7790
  CDS (1)..(1020)

SEQ ID NO: 15606 - protein, 339 aa, Candida glabrata CBS 138; identical to SEQ ID NO: 7791

SEQ ID NO: 15607 - DNA, 1089 bp, Kluyveromyces lactis NRRL Y-1140; identical to SEQ ID NO: 7792
  CDS (1)..(1089)

SEQ ID NO: 15608 - protein, 362 aa, Kluyveromyces lactis NRRL Y-1140; identical to SEQ ID NO: 7793

SEQ ID NO: 15609 - DNA, 1110 bp, Debaryomyces hansenii CBS767; identical to SEQ ID NO: 7794
  CDS (1)..(1110)

SEQ ID NO: 15610 - protein, 369 aa, Debaryomyces hansenii CBS767; identical to SEQ ID NO: 7795

SEQ ID NO: 15611 - DNA, 1059 bp, Yarrowia lipolytica CLIB122; identical to SEQ ID NO: 7796
  CDS (1)..(1059)

SEQ ID NO: 15612 - protein, 352 aa, Yarrowia lipolytica CLIB122; identical to SEQ ID NO: 7797

SEQ ID NO: 15613 - DNA, 2733 bp, Aspergillus nidulans FGSC A4; identical to SEQ ID NO: 7798
  CDS (1)..(2733)

SEQ ID NO: 15614 - protein, 910 aa, Aspergillus nidulans FGSC A4; identical to SEQ ID NO: 7799

SEQ ID NO: 15615 - DNA, 1125 bp, Candida albicans SC5314; identical to SEQ ID NO: 7800
  CDS (1)..(1125): transl_table=12

SEQ ID NO: 15616 - protein, 374 aa, Candida albicans SC5314; identical to SEQ ID NO: 7801

SEQ ID NO: 15617 - DNA, 1119 bp, Cryptococcus neoformans var. neoformans B-3501A; identical to SEQ ID NO: 7802
  CDS (1)..(1119)

SEQ ID NO: 15618 - protein, 372 aa, Cryptococcus neoformans var. neoformans B-3501A; identical to SEQ ID NO: 7803

SEQ ID NO: 15619 - DNA, 1140 bp, Phaeosphaeria nodorum; identical to SEQ ID NO: 7804
  CDS (1)..(1140)

SEQ ID NO: 15620 - protein, 379 aa, Phaeosphaeria nodorum; identical to SEQ ID NO: 7805

SEQ ID NO: 15621 - DNA, 990 bp, Medicago truncatula; identical to SEQ ID NO: 7806
  CDS (1)..(990)

SEQ ID NO: 15622 - protein, 329 aa, Medicago truncatula; identical to SEQ ID NO: 7807

SEQ ID NO: 15623 - DNA, 1059 bp, Aspergillus oryzae; identical to SEQ ID NO: 7808
  CDS (1)..(1059)

SEQ ID NO: 15624 - protein, 352 aa, Aspergillus oryzae; identical to SEQ ID NO: 7809

SEQ ID NO: 15625 - DNA, 1381 bp, Arabidopsis thaliana; identical to SEQ ID NO: 7810
  CDS (53)..(1039)

SEQ ID NO: 15626 - protein, 328 aa, Arabidopsis thaliana; identical to SEQ ID NO: 7811

SEQ ID NO: 15627 - DNA, 999 bp, Schizosaccharomyces pombe; identical to SEQ ID NO: 7812
  CDS (1)..(999)

SEQ ID NO: 15628 - protein, 332 aa, Schizosaccharomyces pombe; identical to SEQ ID NO: 7813

SEQ ID NO: 15629 - DNA, 1017 bp, Saccharomyces cerevisiae; identical to SEQ ID NO: 7778
  CDS (1)..(1017)

SEQ ID NO: 15630 - protein, 338 aa, Saccharomyces cerevisiae; identical to SEQ ID NO: 7779

SEQ ID NO: 15631 - DNA, 987 bp, Brassica napus; identical to SEQ ID NO: 7814
  CDS (1)..(987)

SEQ ID NO: 15632 - protein, 328 aa, Brassica napus; identical to SEQ ID NO: 7815

SEQ ID NO: 15633 - DNA, 993 bp, Glycine max; identical to SEQ ID NO: 7816
  CDS (1)..(993)

SEQ ID NO: 15634 - protein, 330 aa, Glycine max; identical to SEQ ID NO: 7817

SEQ ID NO: 15635 - DNA, 993 bp, Glycine max; identical to SEQ ID NO: 7818
  CDS (1)..(993)

SEQ ID NO: 15636 - protein, 330 aa, Glycine max; identical to SEQ ID NO: 7819

SEQ ID NO: 15637 - DNA, 993 bp, Zea mays; identical to SEQ ID NO: 7820
  CDS (1)..(993)

SEQ ID NO: 15638 - protein, 330 aa, Zea mays; identical to SEQ ID NO: 7821

SEQ ID NO: 15639 - DNA, 27 bp, Artificial sequence
  primer
atggataagaattcagttaacaaagat

SEQ ID NO: 15640 - DNA, 25 bp, Artificial sequence
  primer
tcagcctcttatatatgtcgcatca

SEQ ID NO: 15641 - protein, 297 aa, Artificial sequence; identical to SEQ ID NO: 7824
  consensus sequence
  Variant (2)..(21): Xaa in position 2 to 21 is any amino acid
  Variant (22)..(25): Xaa in position 22 to 25 is any or no amino acid
  Variant (27)..(27): Xaa in position 27 is any amino acid
  Variant (32)..(32): Xaa in position 32 is any amino acid
  Variant (34)..(42): Xaa in position 34 to 42 is any amino acid
  Variant (43)..(49): Xaa in position 43 to 49 is any or no amino acid
  Variant (51)..(52): Xaa in position 51 to 52 is any amino acid
  Variant (54)..(56): Xaa in position 54 to 56 is any amino acid
  Variant (59)..(71): Xaa in position 59 to 71 is any amino acid
  Variant (72)..(74): Xaa in position 72 to 74 is any or no amino acid
  Variant (76)..(78): Xaa in position 76 to 78 is any amino acid
  Variant (80)..(80): Xaa in position 80 is any amino acid
  Variant (84)..(84): Xaa in position 84 is any amino acid
  Variant (86)..(96): Xaa in position 86 to 96 is any amino acid
  Variant (97)..(97): Xaa in position 97 is any or no amino acid
  Variant (99)..(100): Xaa in position 99 to 100 is any amino acid
  Variant (103)..(105): Xaa in position 103 to 105 is any amino acid
  Variant (107)..(110): Xaa in position 107 to 110 is any amino acid
  Variant (112)..(119): Xaa in position 112 to 119 is any amino acid
  Variant (120)..(122): Xaa in position 120 to 122 is any or no amino acid
  Variant (124)..(125): Xaa in position 124 to 125 is any amino acid
  Variant (130)..(130): Xaa in position 130 is any amino acid
  Variant (132)..(138): Xaa in position 132 to 138 is any amino acid
  Variant (139)..(140): Xaa in position 139 to 140 is any or no amino acid
  Variant (142)..(143): Xaa in position 142 to 143 is any amino acid
  Variant (145)..(146): Xaa in position 145 to 146 is any amino acid
  Variant (148)..(148): Xaa in position 148 is any amino acid
  Variant (154)..(154): Xaa in position 154 is any amino acid
  Variant (156)..(156): Xaa in position 156 is any amino acid
  Variant (158)..(161): Xaa in position 158 to 161 is any amino acid
  Variant (162)..(162): Xaa in position 162 is any or no amino acid
  Variant (164)..(165): Xaa in position 164 to 165 is any amino acid
  Variant (167)..(172): Xaa in position 167 to 172 is any amino acid
  Variant (174)..(174): Xaa in position 174 is any amino acid
  Variant (179)..(190): Xaa in position 179 to 190 is any amino acid
  Variant (191)..(191): Xaa in position 191 is any or no amino acid
  Variant (197)..(197): Xaa in position 197 is any amino acid
  Variant (201)..(205): Xaa in position 201 to 205 is any amino acid
  Variant (209)..(211): Xaa in position 209 to 211 is any amino acid
  Variant (212)..(213): Xaa in position 212 to 213 is any or no amino acid
  Variant (215)..(216): Xaa in position 215 to 216 is any amino acid
  Variant (219)..(221): Xaa in position 219 to 221 is any amino acid
  Variant (223)..(232): Xaa in position 223 to 232 is any amino acid
  Variant (234)..(235): Xaa in position 234 to 235 is any amino acid
  Variant (237)..(239): Xaa in position 237 to 239 is any amino acid
  Variant (241)..(243): Xaa in position 241 to 243 is any amino acid
  Variant (245)..(261): Xaa in position 245 to 261 is any amino acid
  Variant (262)..(262): Xaa in position 262 is any or no amino acid
  Variant (264)..(264): Xaa in position 264 is any amino acid
  Variant (266)..(266): Xaa in position 266 is any amino acid
  Variant (268)..(268): Xaa in position 268 is any amino acid
  Variant (270)..(270): Xaa in position 270 is any amino acid
  Variant (273)..(277): Xaa in position 273 to 277 is any amino acid
  Variant (278)..(290): Xaa in position 278 to 290 is any or no amino acid
  Variant (292)..(295): Xaa in position 292 to 295 is any amino acid

SEQ ID NO: 15642 - protein, 43 aa, Artificial sequence; identical to SEQ ID NO: 7825
  protein pattern
  Variant (2)..(7): Xaa in position 2 to 7 is any amino acid
  Variant (9)..(9): Xaa in position 9 is Phe, Ile or Leu
  Variant (13)..(13): Xaa in position 13 is Lys or Arg
  Variant (14)..(14): Xaa in position 14 is Ile or Leu
  Variant (15)..(16): Xaa in position 15 to 16 is any amino acid
  Variant (17)..(17): Xaa in position 17 is Phe, Ile, Leu or Met
  Variant (18)..(18): Xaa in position 18 is any amino acid
  Variant (19)..(19): Xaa in position 19 is Gly, Asn or Pro
  Variant (20)..(20): Xaa in position 20 is Phe or Leu
  Variant (21)..(24): Xaa in position 21 to 24 is any amino acid
  Variant (25)..(25): Xaa in position 25 is Ala, Asn, Ser or Thr
  Variant (30)..(30): Xaa in position 30 is His or Tyr
  Variant (31)..(31): Xaa in position 31 is Ile, Leu or Val
  Variant (32)..(32): Xaa in position 32 is Ser or Thr
  Variant (35)..(35): Xaa in position 35 is any amino acid
  Variant (36)..(36): Xaa in position 36 is Ile or Leu
  Variant (37)..(37): Xaa in position 37 is Ala, Glu, Gln, Ser or Thr
  Variant (38)..(38): Xaa in position 38 is any amino acid
  Variant (39)..(39): Xaa in position 39 is Ile, Leu or Met
  Variant (40)..(40): Xaa in position 40 is Ala, Glu or Ser
  Variant (41)..(41): Xaa in position 41 is Gly or Asn
  Variant (43)..(43): Xaa in position 43 is Asp, Glu or Ser

SEQ ID NO: 15643 - protein, 37 aa, Artificial sequence; identical to SEQ ID NO: 7826
  protein pattern
  Variant (2)..(3): Xaa in position 2 to 3 is any amino acid
  Variant (5)..(5): Xaa in position 5 is Asp or Glu
  Variant (7)..(7): Xaa in position 7 is any or no amino acid
  Variant (9)..(9): Xaa in position 9 is any or no amino acid
  Variant (11)..(11): Xaa in position 11 is any amino acid
  Variant (12)..(12): Xaa in position 12 is Ile or Leu
  Variant (13)..(13): Xaa in position 13 is Lys or Arg
  Variant (14)..(14): Xaa in position 14 is any amino acid
  Variant (15)..(15): Xaa in position 15 is Ile or Met
  Variant (16)..(16): Xaa in position 16 is Glu, Lys or Arg
  Variant (18)..(18): Xaa in position 18 is Ile, Leu, Met or Val
  Variant (19)..(19): Xaa in position 19 is Asp, Glu, Asn, Gln or Ser
  Variant (20)..(20): Xaa in position 20 is any amino acid
  Variant (21)..(21): Xaa in position 21 is Phe or Leu
  Variant (22)..(23): Xaa in position 22 to 23 is any amino acid
  Variant (25)..(26): Xaa in position 25 to 26 is any amino acid
  Variant (28)..(28): Xaa in position 28 is Phe, Trp or Tyr
  Variant (29)..(29): Xaa in position 29 is Phe or Leu
  Variant (30)..(30): Xaa in position 30 is Gly or Val
  Variant (31)..(31): Xaa in position 31 is any amino acid
  Variant (33)..(33): Xaa in position 33 is any amino acid
  Variant (35)..(36): Xaa in position 35 to 36 is any amino acid
  Variant (37)..(37): Xaa in position 37 is Ile or Val

SEQ ID NO: 15644 - protein, 33 aa, Artificial sequence; identical to SEQ ID NO: 7827
  protein pattern
  Variant (2)..(2): Xaa in position 2 is any amino acid
  Variant (3)..(3): Xaa in position 3 is Thr or Val
  Variant (6)..(6): Xaa in position 6 is Phe, Ile or Val
  Variant (7)..(7): Xaa in position 7 is Gly, Ser or Thr
  Variant (8)..(8): Xaa in position 8 is Ala, Gly, Asn or Ser
  Variant (10)..(10): Xaa in position 10 is any amino acid
  Variant (11)..(11): Xaa in position 11 is Ile, Leu or Val
  Variant (12)..(13): Xaa in position 12 to 13 is any amino acid
  Variant (14)..(14): Xaa in position 14 is Ile, Leu or Val
  Variant (15)..(15): Xaa in position 15 is Asp, Glu or Lys
  Variant (16)..(16): Xaa in position 16 is any amino acid
  Variant (17)..(17): Xaa in position 17 is Ile, Leu or Val
  Variant (18)..(19): Xaa in position 18 to 19 is any amino acid
  Variant (21)..(22): Xaa in position 21 to 22 is any amino acid
  Variant (24)..(24): Xaa in position 24 is Glu or Thr
  Variant (25)..(25): Xaa in position 25 is Asp or Glu
  Variant (26)..(26): Xaa in position 26 is Phe, Ile or Leu
  Variant (28)..(28): Xaa in position 28 is any amino acid
  Variant (29)..(30): Xaa in position 29 to 30 is any or no amino acid
  Variant (32)..(32): Xaa in position 32 is any amino acid
  Variant (33)..(33): Xaa in position 33 is Ile, Leu or Val

SEQ ID NO: 15645 - protein, 10 aa, Artificial sequence
  protein pattern
  Variant (2)..(2): Xaa in position 2 is any amino acid
  Variant (4)..(4): Xaa in position 4 is Ile or Val
  Variant (6)..(6): Xaa in position 6 is Phe or Leu
  Variant (8)..(8): Xaa in position 8 is any amino acid
  Variant (10)..(10): Xaa in position 10 is Leu or Pro
LXTXYXEXNX

SEQ ID NO: 15646 - DNA, 3147 bp, Saccharomyces cerevisiae
  CDS (1)..(3147)
atgcctataacgtcaagccccgatctgttctatctcaatgattgtgatgtcgtctattggtatgacctcactcgcttagtgtgtcattatgttaatttaacagagcgcgacctattggcaaatgaacgggaaaagtttctaacttccttggatttattaacagctcaaataacctatgtttatatgcttttcaggaatctccgtttagttgaggatagtttcaaaaaaaccctcaaaaaactaatttacaccttgtctaggttttcaataaatgcaaatatttggtttcattccacattgtttgaagaaagagaagccatagcctcccagaaggatccagaaagaagatcccctcttctacagtcaatcctaggaaccttccaaaaatttcattttctactgcgtttactacatttcctctcaaatcctaacgaacttacaatactgcctcaattgactcctcgatttttcaaggattctttcaatacaatttcatggaataacccgtttttgcgtaagcgtctcaaccagcatatgtcccatgacctaccgagacagatgattaaagccgttgctggtgcttcaggaattgttgcggaaaatattgatgaaattccagcttccaaacagggcacttcatgctcgtcagaaacgtctcaccattcaccatcagccccgtttcaaagaaggagaggaggtaccattttctctaatgtgtcaggaagttccgatgagtctgacaccatatggtccaaaaggaaaaaaccatacccgctaaatgaagaaactctaagccttgtaagggccaggaagaagcagcttgatggtaaactaaaacaaatgatcaaaagtgctaatgaatatctcagtaacacggctaatttttcaaaaatgttgaattttgaaatgaatttcaaaacctacgaagaagtaagcggaacaattcctataattgatattctggaaaacctagatttaactatttttctaaacttgagagagttgggagatgagaatagagtttttgacgaagatgtcgctattgatgatgaagatgaagagtttttgaaacattctttatcatccctatcgtatatcttatccgactattttaatatgaagcaatattttcatgatgtagtagtgaaatttataattgtcgcccagcatttgacattagaggatcctttcgttttctcgccaatgcaaaacgacttgcctaccggttattatgaaccaatgaaaccttcatccttgaatttagataatgccaaggataagaagaatgggagccaaaatactgatatccaagaggaggaagatgaatatgagccagacccggatagtcttattctcttccacaacctcatcaatcaagattctgatttcaatgatttaaagttttttaatctcgcccacgtttttaaaaaatcctgtgatgactattttgatgtgcttaaactagccattgagttcgtgaatcaattaattctagaaagagagaatttgttaaattatgctgctagaatgatgaaaaacaatatcacggaattgctattgcgcggggaagaaggctatgggtcctatgacggcggtgaaactgccgaaaaaagtgacacgaatgctgtttatgcagattcagatactaaagacaatgacgaatggcgtgacagccaagtcaaattaccgaggtatttgcagcgcgagtatgacagtgaactgatttggggctctaacaataggattaaaggtggttctaaacacgcactgatctcttacttgacagataatgaaaagaaggatctatttttcgatattacttttttaatcactttcagaagcatctttactacaacggagtttttaagctacttgatttcgcaatataatttggatccaccagaggatttgtgctttgaagaatacaatgaatgggtgacgaaaaagcttataccggttaaatgtagggtggttgagattatgacaacctttttcaagcaatattggttcctgggctatgatgagcccgatcttgcgaccctaaatctggattattttgcgcaagtagcaatcaaggaaaatataacaggatctgtggaattactaaaggaggtcaatcagaagtttaaacatggtaatatacaagaagcgactgcaccaatgaaaacgttagatcaacagatctgccaggaccattactcgggcactttatactctaccacggaatccattttggccgtcgatccagttttatttgccactcaattaacgatactagagcatgaaatttattgtgagataaccatttttgattgtttacaaaaaatttggaagaacaagtatacaaaatcgtatggggcttcaccgggtttgaacgagtttatcagttttgccaataaactgacaaatttcatatcctactctgttgtaaaggaggctgataaaagtaagcgcgccaagctactctctcattttatttttatcgcagaatattgtaggaaattcaataacttttcttccatgactgcaatcatttcagcattatattcttcaccaatttatcgtttagagaaaacctggcaggcagttattcctcaaacgagagatctattgcagtcactgaacaagttgatggatcccaagaaaaatttcataaattatagaaacgagctgaaatctttacatagcgctccctgcgtaccgtttttcggcgtttatttatctgatctaacctttactgattccggaaatccggattatcttgtcttggaacatggtttaaagggtgtccatgatgagaagaaatatataaacttcaacaaaaggagcagacttgttgatatcttacaagagatcatatatttcaagaaaacacattatgatttcactaaagatcggacggtaattgaatgtatatcaaattcattggaaaacatcccccatattgagaaacaataccaattatcattaattattgaaccaaaaccaagaaagaaagtcgttccgaattccaattcgaataataaatcacaagaaaaatccagggatgaccaaaccgatgaaggaaaaacatccactaagaaagacagatttccaaaatttcaattacataagacaaagaaaaaagctcccaaggtttctaagtaa

SEQ ID NO: 15647 - protein, 1048 aa, Saccharomyces cerevisiae
MPITSSPDLFYLNDCDVVYWYDLTRLVCHYVNLTERDLLANEREKFLTSLDLLTAQITYVYMLFRNLRLVEDSFKKTLKKLIYTLSRFSINANIWFHSTLFEEREAIASQKDPERRSPLLQSILGTFQKFHFLLRLLHFLSNPNELTILPQLTPRFFKDSFNTISWNNPFLRKRLNQHMSHDLPRQMIKAVAGASGIVAENIDEIPASKQGTSCSSETSHHSPSAPFQRRRGGTIFSNVSGSSDESDTIWSKRKKPYPLNEETLSLVRARKKQLDGKLKQMIKSANEYLSNTANFSKMLNFEMNFKTYEEVSGTIPIIDILENLDLTIFLNLRELGDENRVFDEDVAIDDEDEEFLKHSLSSLSYILSDYFNMKQYFHDVVVKFIIVAQHLTLEDPFVFSPMQNDLPTGYYEPMKPSSLNLDNAKDKKNGSQNTDIQEEEDEYEPDPDSLILFHNLINQDSDFNDLKFFNLAHVFKKSCDDYFDVLKLAIEFVNQLILERENLLNYAARMMKNNITELLLRGEEGYGSYDGGETAEKSDTNAVYADSDTKDNDEWRDSQVKLPRYLQREYDSELIWGSNNRIKGGSKHALISYLTDNEKKDLFFDITFLITFRSIFTTTEFLSYLISQYNLDPPEDLCFEEYNEWVTKKLIPVKCRVVEIMTTFFKQYWFLGYDEPDLATLNLDYFAQVAIKENITGSVELLKEVNQKFKHGNIQEATAPMKTLDQQICQDHYSGTLYSTTESILAVDPVLFATQLTILEHEIYCEITIFDCLQKIWKNKYTKSYGASPGLNEFISFANKLTNFISYSVVKEADKSKRAKLLSHFIFIAEYCRKFNNFSSMTAIISALYSSPIYRLEKTWQAVIPQTRDLLQSLNKLMDPKKNFINYRNELKSLHSAPCVPFFGVYLSDLTFTDSGNPDYLVLEHGLKGVHDEKKYINFNKRSRLVDILQEIIYFKKTHYDFTKDRTVIECISNSLENIPHIEKQYQLSLIIEPKPRKKVVPNSNSNNKSQEKSRDDQTDEGKTSTKKDRFPKFQLHKTKKKAPKVSK

SEQ ID NO: 15648 - DNA, 3927 bp, Candida glabrata CBS 138; identical to SEQ ID NO: 8516
  CDS (1)..(3927)

SEQ ID NO: 15649 - protein, 1308 aa, Candida glabrata CBS 138; identical to SEQ ID NO: 8517

SEQ ID NO: 15650 - DNA, 4695 bp, Candida glabrata CBS 138; identical to SEQ ID NO: 8518
  CDS (1)..(4695)

SEQ ID NO: 15651 - protein, 1564 aa, Candida glabrata CBS 138; identical to SEQ ID NO: 8519

SEQ ID NO: 15652 - DNA, 4614 bp, Kluyveromyces lactis NRRL Y-1140; identical to SEQ ID NO: 8520
  CDS (1)..(4614)

SEQ ID NO: 15653 - protein, 1537 aa, Kluyveromyces lactis NRRL Y-1140; identical to SEQ ID NO: 8521

SEQ ID NO: 15654 - DNA, 3933 bp, Debaryomyces hansenii CBS767; identical to SEQ ID NO: 8522
  CDS (1)..(3933)

SEQ ID NO: 15655 - protein, 1310 aa, Debaryomyces hansenii CBS767; identical to SEQ ID NO: 8523

SEQ ID NO: 15656 - DNA, 6043 bp, Candida albicans; identical to SEQ ID NO: 8524
  CDS (1513)..(5514): transl_table=12

SEQ ID NO: 15657 - protein, 1333 aa, Candida albicans; identical to SEQ ID NO: 8525

SEQ ID NO: 15658 - DNA, 5398 bp, Saccharomyces cerevisiae; identical to SEQ ID NO: 8526
  CDS (313)..(5082)

SEQ ID NO: 15659 - protein, 1589 aa, Saccharomyces cerevisiae; identical to SEQ ID NO: 8527

SEQ ID NO: 15660 - DNA, 3147 bp, Saccharomyces cerevisiae; identical to SEQ ID NO: 8514
  CDS (1)..(3147)

SEQ ID NO: 15661 - protein, 1048 aa, Saccharomyces cerevisiae; identical to SEQ ID NO: 8515

SEQ ID NO: 15662 - DNA, 23 bp, Artificial sequence
  primer
atgcctataacgtcaagccccga

SEQ ID NO: 15663 - DNA, 25 bp, Artificial sequence
  primer
ttacttagaaaccttgggagctttt

SEQ ID NO: 15664 - protein, 1604 aa, Artificial sequence; identical to SEQ ID NO: 8530
  consensus sequence
  Variant (2)..(14): Xaa in position 2 to 14 is any amino acid
  Variant (15)..(19): Xaa in position 15 to 19 is any or no amino acid
  Variant (21)..(24): Xaa in position 21 to 24 is any amino acid
  Variant (26)..(32): Xaa in position 26 to 32 is any amino acid
  Variant (34)..(36): Xaa in position 34 to 36 is any amino acid
  Variant (42)..(51): Xaa in position 42 to 51 is any amino acid
  Variant (52)..(52): Xaa in position 52 is any or no amino acid
  Variant (55)..(63): Xaa in position 55 to 63 is any amino acid
  Variant (64)..(429): Xaa in position 64 to 429 is any or no amino acid
  Variant (432)..(435): Xaa in position 432 to 435 is any amino acid
  Variant (437)..(439): Xaa in position 437 to 439 is any amino acid
  Variant (441)..(442): Xaa in position 441 to 442 is any amino acid
  Variant (444)..(465): Xaa in position 444 to 465 is any amino acid
  Variant (467)..(476): Xaa in position 467 to 476 is any amino acid
  Variant (478)..(484): Xaa in position 478 to 484 is any amino acid
  Variant (486)..(510): Xaa in position 486 to 510 is any amino acid
  Variant (511)..(516): Xaa in position 511 to 516 is any or no amino acid
  Variant (518)..(534): Xaa in position 518 to 534 is any amino acid
  Variant (535)..(583): Xaa in position 535 to 583 is any or no amino acid
  Variant (585)..(768): Xaa in position 585 to 768 is any amino acid
  Variant (769)..(874): Xaa in position 769 to 874 is any or no amino acid
  Variant (876)..(888): Xaa in position 876 to 888 is any amino acid
  Variant (890)..(891): Xaa in position 890 to 891 is any amino acid
  Variant (893)..(895): Xaa in position 893 to 895 is any amino acid
  Variant (897)..(928): Xaa in position 897 to 928 is any amino acid
  Variant (929)..(939): Xaa in position 929 to 939 is any or no amino acid
  Variant (941)..(944): Xaa in position 941 to 944 is any amino acid
  Variant (947)..(948): Xaa in position 947 to 948 is any amino acid
  Variant (951)..(956): Xaa in position 951 to 956 is any amino acid
  Variant (958)..(959): Xaa in position 958 to 959 is any amino acid
  Variant (961)..(962): Xaa in position 961 to 962 is any amino acid
  Variant (965)..(965): Xaa in position 965 is any amino acid
  Variant (968)..(969): Xaa in position 968 to 969 is any amino acid
  Variant (971)..(995): Xaa in position 971 to 995 is any amino acid
  Variant (996)..(1022): Xaa in position 996 to 1022 is any or no amino acid
  Variant (1024)..(1066): Xaa in position 1024 to 1066 is any amino acid
  Variant (1067)..(1068): Xaa in position 1067 to 1068 is any or no amino acid
  Variant (1070)..(1071): Xaa in position 1070 to 1071 is any amino acid
  Variant (1075)..(1077): Xaa in position 1075 to 1077 is any amino acid
  Variant (1081)..(1081): Xaa in position 1081 is any amino acid
  Variant (1083)..(1083): Xaa in position 1083 is any amino acid
  Variant (1085)..(1091): Xaa in position 1085 to 1091 is any amino acid
  Variant (1094)..(1095): Xaa in position 1094 to 1095 is any amino acid
  Variant (1097)..(1121): Xaa in position 1097 to 1121 is any amino acid
  Variant (1122)..(1150): Xaa in position 1122 to 1150 is any or no amino acid
  Variant (1153)..(1153): Xaa in position 1153 is any amino acid
  Variant (1155)..(1161): Xaa in position 1155 to 1161 is any amino acid
  Variant (1163)..(1167): Xaa in position 1163 to 1167 is any amino acid
  Variant (1169)..(1169): Xaa in position 1169 is any amino acid
  Variant (1171)..(1171): Xaa in position 1171 is any amino acid
  Variant (1174)..(1174): Xaa in position 1174 is any amino acid
  Variant (1176)..(1176): Xaa in position 1176 is any amino acid
  Variant (1179)..(1181): Xaa in position 1179 to 1181 is any amino acid
  Variant (1184)..(1188): Xaa in position 1184 to 1188 is any amino acid
  Variant (1190)..(1191): Xaa in position 1190 to 1191 is any amino acid
  Variant (1193)..(1196): Xaa in position 1193 to 1196 is any amino acid
  Variant (1198)..(1198): Xaa in position 1198 is any amino acid
  Variant (1201)..(1207): Xaa in position 1201 to 1207 is any amino acid
  Variant (1210)..(1212): Xaa in position 1210 to 1212 is any amino acid
  Variant (1215)..(1215): Xaa in position 1215 is any amino acid
  Variant (1217)..(1220): Xaa in position 1217 to 1220 is any amino acid
  Variant (1224)..(1224): Xaa in position 1224 is any amino acid
  Variant (1227)..(1228): Xaa in position 1227 to 1228 is any amino acid
  Variant (1232)..(1232): Xaa in position 1232 is any amino acid
  Variant (1234)..(1236): Xaa in position 1234 to 1236 is any amino acid
  Variant (1238)..(1239): Xaa in position 1238 to 1239 is any amino acid
  Variant (1241)..(1243): Xaa in position 1241 to 1243 is any amino acid
  Variant (1246)..(1256): Xaa in position 1246 to 1256 is any amino acid
  Variant (1258)..(1260): Xaa in position 1258 to 1260 is any amino acid
  Variant (1262)..(1286): Xaa in position 1262 to 1286 is any amino acid
  Variant (1287)..(1289): Xaa in position 1287 to 1289 is any or no amino acid
  Variant (1291)..(1332): Xaa in position 1291 to 1332 is any amino acid
  Variant (1333)..(1354): Xaa in position 1333 to 1354 is any or no amino acid
  Variant (1356)..(1356): Xaa in position 1356 is any amino acid
  Variant (1358)..(1361): Xaa in position 1358 to 1361 is any amino acid
  Variant (1363)..(1363): Xaa in position 1363 is any amino acid
  Variant (1367)..(1368): Xaa in position 1367 to 1368 is any amino acid
  Variant (1370)..(1371): Xaa in position 1370 to 1371 is any amino acid
  Variant (1374)..(1375): Xaa in position 1374 to 1375 is any amino acid
  Variant (1378)..(1378): Xaa in position 1378 is any amino acid
  Variant (1380)..(1380): Xaa in position 1380 is any amino acid
  Variant (1383)..(1385): Xaa in position 1383 to 1385 is any amino acid
  Variant (1388)..(1388): Xaa in position 1388 is any amino acid
  Variant (1390)..(1398): Xaa in position 1390 to 1398 is any amino acid
  Variant (1399)..(1399): Xaa in position 1399 is any or no amino acid
  Variant (1401)..(1402): Xaa in position 1401 to 1402 is any amino acid
  Variant (1405)..(1407): Xaa in position 1405 to 1407 is any amino acid
  Variant (1409)..(1409): Xaa in position 1409 is any amino acid
  Variant (1412)..(1413): Xaa in position 1412 to 1413 is any amino acid
  Variant (1415)..(1417): Xaa in position 1415 to 1417 is any amino acid
  Variant (1419)..(1425): Xaa in position 1419 to 1425 is any amino acid
  Variant (1428)..(1433): Xaa in position 1428 to 1433 is any amino acid
  Variant (1435)..(1436): Xaa in position 1435 to 1436 is any amino acid
  Variant (1439)..(1440): Xaa in position 1439 to 1440 is any amino acid
  Variant (1442)..(1444): Xaa in position 1442 to 1444 is any amino acid
  Variant (1454)..(1454): Xaa in position 1454 is any amino acid
  Variant (1463)..(1463): Xaa in position 1463 is any amino acid
  Variant (1466)..(1467): Xaa in position 1466 to 1467 is any amino acid
  Variant (1470)..(1479): Xaa in position 1470 to 1479 is any amino acid
  Variant (1481)..(1483): Xaa in position 1481 to 1483 is any amino acid
  Variant (1485)..(1485): Xaa in position 1485 is any amino acid
  Variant (1488)..(1488): Xaa in position 1488 is any amino acid
  Variant (1490)..(1491): Xaa in position 1490 to 1491 is any amino acid
  Variant (1494)..(1495): Xaa in position 1494 to 1495 is any amino acid
  Variant (1498)..(1499): Xaa in position 1498 to 1499 is any amino acid
  Variant (1501)..(1507): Xaa in position 1501 to 1507 is any amino acid
  Variant (1522)..(1524): Xaa in position 1522 to 1524 is any amino acid
  Variant (1529)..(1529): Xaa in position 1529 is any amino acid
  Variant (1531)..(1537): Xaa in position 1531 to 1537 is any amino acid
  Variant (1538)..(1546): Xaa in position 1538 to 1546 is any or no amino acid
  Variant (1549)..(1549): Xaa in position 1549 is any amino acid
  Variant (1552)..(1556): Xaa in position 1552 to 1556 is any amino acid
  Variant (1558)..(1560): Xaa in position 1558 to 1560 is any amino acid
  Variant (1562)..(1563): Xaa in position 1562 to 1563 is any amino acid
  Variant (1566)..(1568): Xaa in position 1566 to 1568 is any amino acid
  Variant (1570)..(1585): Xaa in position 1570 to 1585 is any amino acid
  Variant (1587)..(1588): Xaa in position 1587 to 1588 is any amino acid
  Variant (1590)..(1590): Xaa in position 1590 is any amino acid
  Variant (1593)..(1593): Xaa in position 1593 is any amino acid
  Variant (1596)..(1596): Xaa in position 1596 is any amino acid
  Variant (1600)..(1601): Xaa in position 1600 to 1601 is any amino acid

SEQ ID NO: 15665 - protein, 59 aa, Artificial sequence; identical to SEQ ID NO: 8531
  protein pattern
  Variant (2)..(2): Xaa in position 2 is any amino acid
  Variant (5)..(5): Xaa in position 5 is Asp or Asn
  Variant (6)..(6): Xaa in position 6 is Pro or Ser
  Variant (7)..(7): Xaa in position 7 is any amino acid
  Variant (8)..(8): Xaa in position 8 is Lys or Arg
  Variant (11)..(12): Xaa in position 11 to 12 is any amino acid
  Variant (15)..(15): Xaa in position 15 is Asp, Glu or Asn
  Variant (16)..(16): Xaa in position 16 is any amino acid
  Variant (18)..(18): Xaa in position 18 is Lys or Arg
  Variant (19)..(19): Xaa in position 19 is any amino acid
  Variant (20)..(20): Xaa in position 20 is Ile, Leu or Val
  Variant (21)..(21): Xaa in position 21 is any amino acid
  Variant (22)..(22): Xaa in position 22 is Asp or Ser
  Variant (23)..(23): Xaa in position 23 is any amino acid
  Variant (24)..(24): Xaa in position 24 is Ala or Pro
  Variant (39)..(39): Xaa in position 39 is Thr or Val
  Variant (40)..(41): Xaa in position 40 to 41 is any amino acid
  Variant (44)..(44): Xaa in position 44 is Pro or Ser
  Variant (46)..(46): Xaa in position 46 is any amino acid
  Variant (48)..(54): Xaa in position 48 to 54 is any amino acid
  Variant (55)..(55): Xaa in position 55 is Gly or Asn
  Variant (56)..(56): Xaa in position 56 is Phe or Val
  Variant (57)..(57): Xaa in position 57 is any amino acid
  Variant (58)..(58): Xaa in position 58 is Asp or Lys
  Variant (59)..(59): Xaa in position 59 is Glu or Arg

SEQ ID NO: 15666 - protein, 60 aa, Artificial sequence; identical to SEQ ID NO: 8532
  protein pattern
  Variant (2)..(2): Xaa in position 2 is any amino acid
  Variant (3)..(3): Xaa in position 3 is Phe or Tyr
  Variant (4)..(4): Xaa in position 4 is Ile or Val
  Variant (5)..(5): Xaa in position 5 is Ala, Gly or Ser
  Variant (6)..(6): Xaa in position 6 is Phe, His or Tyr
  Variant (7)..(7): Xaa in position 7 is any amino acid
  Variant (8)..(8): Xaa in position 8 is Ile or Val
  Variant (9)..(9): Xaa in position 9 is Leu or Val
  Variant (10)..(10): Xaa in position 10 is Lys or Arg
  Variant (11)..(11): Xaa in position 11 is any amino acid
  Variant (12)..(12): Xaa in position 12 is Ala, Gln or Thr
  Variant (13)..(13): Xaa in position 13 is Asp or Glu
  Variant (14)..(16): Xaa in position 14 to 16 is any amino acid
  Variant (18)..(18): Xaa in position 18 is Ala, Ser or Val
  Variant (19)..(19): Xaa in position 19 is any amino acid
  Variant (20)..(20): Xaa in position 20 is Ile or Leu
  Variant (21)..(22): Xaa in position 21 to 22 is any amino acid
  Variant (23)..(23): Xaa in position 23 is Phe, His or Tyr
  Variant (25)..(25): Xaa in position 25 is Ile or Val
  Variant (26)..(26): Xaa in position 26 is any amino acid
  Variant (27)..(27): Xaa in position 27 is Ile or Val
  Variant (28)..(28): Xaa in position 28 is Ala or Ser
  Variant (29)..(29): Xaa in position 29 is Asp, Glu or Gln
  Variant (30)..(30): Xaa in position 30 is any amino acid
  Variant (32)..(34): Xaa in position 32 to 34 is any amino acid
  Variant (35)..(35): Xaa in position 35 is any or no amino acid
  Variant (37)..(37): Xaa in position 37 is any or no amino acid
  Variant (45)..(45): Xaa in position 45 is Ile or Val
  Variant (54)..(54): Xaa in position 54 is Phe, His or Tyr
  Variant (57)..(58): Xaa in position 57 to 58 is any amino acid
  Variant (60)..(60): Xaa in position 60 is Phe or Trp

SEQ ID NO: 15667 - protein, 50 aa, Artificial sequence; identical to SEQ ID NO: 8533
  protein pattern
  Variant (3)..(3): Xaa in position 3 is Phe, Ile, Leu or Val
  Variant (4)..(5): Xaa in position 4 to 5 is any amino acid
  Variant (6)..(6): Xaa in position 6 is Ile or Leu
  Variant (7)..(7): Xaa in position 7 is Phe or Ile
  Variant (8)..(8): Xaa in position 8 is any amino acid
  Variant (9)..(9): Xaa in position 9 is Gln or Arg
  Variant (10)..(10): Xaa in position 10 is Phe or Tyr
  Variant (11)..(11): Xaa in position 11 is Asp, Glu or Asn
  Variant (12)..(13): Xaa in position 12 to 13 is any amino acid
  Variant (14)..(14): Xaa in position 14 is Ala or Pro
  Variant (17)..(17): Xaa in position 17 is Asp, Gly or Asn
  Variant (19)..(19): Xaa in position 19 is Cys or Ser
  Variant (20)..(20): Xaa in position 20 is Phe or Tyr
  Variant (21)..(22): Xaa in position 21 to 22 is Asp or Glu
  Variant (25)..(25): Xaa in position 25 is any amino acid
  Variant (27)..(27): Xaa in position 27 is Ile or Val
  Variant (28)..(28): Xaa in position 28 is Asp, Glu, Ser or Thr
  Variant (29)..(29): Xaa in position 29 is Lys or Arg
  Variant (31)..(32): Xaa in position 31 to 32 is any amino acid
  Variant (34)..(34): Xaa in position 34 is any amino acid
  Variant (35)..(35): Xaa in position 35 is Lys or Arg
  Variant (36)..(36): Xaa in position 36 is any amino acid
  Variant (39)..(39): Xaa in position 39 is Ile, Met or Val
  Variant (40)..(40): Xaa in position 40 is any amino acid
  Variant (41)..(41): Xaa in position 41 is Ile, Leu or Val
  Variant (42)..(42): Xaa in position 42 is Ile, Leu or Met
  Variant (43)..(45): Xaa in position 43 to 45 is any amino acid
  Variant (46)..(46): Xaa in position 46 is Phe, Ile or Leu
  Variant (47)..(48): Xaa in position 47 to 48 is any amino acid
  Variant (49)..(49): Xaa in position 49 is Phe or Tyr

SEQ ID NO: 15668 - protein, 29 aa, Artificial sequence
  protein pattern
  Variant (2)..(3): Xaa in position 2 to 3 is any amino acid
  Variant (5)..(5): Xaa in position 5 is any amino acid
  Variant (6)..(6): Xaa in position 6 is any or no amino acid
  Variant (8)..(8): Xaa in position 8 is Asn, Ser or Thr
  Variant (9)..(9): Xaa in position 9 is Ile, Leu or Val
  Variant (10)..(10): Xaa in position 10 is Ile or Leu
  Variant (14)..(14): Xaa in position 14 is Ala or Thr
  Variant (16)..(16): Xaa in position 16 is Met or Val
  Variant (18)..(18): Xaa in position 18 is any amino acid
  Variant (19)..(19): Xaa in position 19 is Asp or Asn
  Variant (20)..(20): Xaa in position 20 is Asp, Asn or Arg
  Variant (21)..(21): Xaa in position 21 is Phe, Ile or Leu
  Variant (22)..(24): Xaa in position 22 to 24 is any amino acid
  Variant (27)..(28): Xaa in position 27 to 28 is any amino acid
LXXEXXEXXXNYAXRXMXXXXXXXLLXXE

SEQ ID NO: 15669 - protein, 21 aa, Artificial sequence
  protein pattern
  Variant (2)..(2): Xaa in position 2 is Pro or Val
  Variant (4)..(4): Xaa in position 4 is Ile, Leu or Val
  Variant (5)..(5): Xaa in position 5 is any amino acid
  Variant (9)..(9): Xaa in position 9 is Phe, Ile or Leu
  Variant (10)..(10): Xaa in position 10 is any amino acid
  Variant (11)..(11): Xaa in position 11 is Asp, Gly, Asn or Ser
  Variant (12)..(12): Xaa in position 12 is Glu or Ser
  Variant (14)..(14): Xaa in position 14 is Glu, Asn or Ser
  Variant (15)..(15): Xaa in position 15 is Gly or Thr
  Variant (16)..(16): Xaa in position 16 is Gly or Ile
  Variant (17)..(17): Xaa in position 17 is Asn, Ser or Val
  Variant (19)..(19): Xaa in position 19 is Cys, Asn or Thr
  Variant (20)..(20): Xaa in position 20 is any amino acid
  Variant (21)..(21): Xaa in position 21 is Pro or Ser
LXQXXPRFXXXXFXXXXWXXX

SEQ ID NO: 15670 - protein, 26 aa, Artificial sequence
  protein pattern
  Variant (2)..(5): Xaa in position 2 to 5 is any amino acid
  Variant (6)..(12): Xaa in position 6 to 12 is any or no amino acid
  Variant (14)..(14): Xaa in position 14 is Asp or Glu
  Variant (15)..(15): Xaa in position 15 is Glu or Lys
  Variant (18)..(18): Xaa in position 18 is Glu or Gln
  Variant (19)..(19): Xaa in position 19 is Ile or Leu
  Variant (22)..(22): Xaa in position 22 is any amino acid
  Variant (23)..(23): Xaa in position 23 is Ile, Leu or Val
  Variant (26)..(26): Xaa in position 26 is Lys or Arg
EXXXXXXXXXXXIXXQYXXSLXXEPX

SEQ ID NO: 15671 - protein, 35 aa, Artificial sequence; identical to SEQ ID NO: 8537
  protein pattern
  Variant (2)..(4): Xaa in position 2 to 4 is any amino acid
  Variant (5)..(9): Xaa in position 5 to 9 is any or no amino acid
  Variant (11)..(11): Xaa in position 11 is Glu or Lys
  Variant (12)..(12): Xaa in position 12 is any amino acid
  Variant (13)..(13): Xaa in position 13 is Ile, Leu or Val
  Variant (14)..(15): Xaa in position 14 to 15 is any amino acid
  Variant (16)..(16): Xaa in position 16 is Ala, Cys, Asn or Thr
  Variant (17)..(17): Xaa in position 17 is any amino acid
  Variant (18)..(18): Xaa in position 18 is Ala, Leu or Pro
  Variant (19)..(19): Xaa in position 19 is Ile, Leu or Met
  Variant (20)..(20): Xaa in position 20 is Ile, Leu or Val
  Variant (21)..(21): Xaa in position 21 is Asp, Glu or Asn
  Variant (22)..(22): Xaa in position 22 is Ile, Leu or Met
  Variant (23)..(23): Xaa in position 23 is Ile or Leu
  Variant (25)..(25): Xaa in position 25 is Asn or Ser
  Variant (26)..(26): Xaa in position 26 is Phe or Leu
  Variant (28)..(28): Xaa in position 28 is Phe or Leu
  Variant (29)..(29): Xaa in position 29 is Ser or Thr
  Variant (30)..(30): Xaa in position 30 is Ile, Met or Val
  Variant (32)..(33): Xaa in position 32 to 33 is any amino acid
  Variant (34)..(34): Xaa in position 34 is Ile, Leu, Met or Val
  Variant (35)..(35): Xaa in position 35 is His, Lys or Arg

SEQ ID NO: 15672 - protein, 18 aa, Artificial sequence
  protein pattern
  Variant (2)..(2): Xaa in position 2 is Ile, Leu or Val
  Variant (3)..(3): Xaa in position 3 is Glu, Asn, Gln, Ser or Thr
  Variant (4)..(4): Xaa in position 4 is Glu or Gly
  Variant (6)..(7): Xaa in position 6 to 7 is any amino acid
  Variant (9)..(9): Xaa in position 9 is any or no amino acid
  Variant (11)..(12): Xaa in position 11 to 12 is any amino acid
  Variant (13)..(13): Xaa in position 13 is any or no amino acid
  Variant (15)..(15): Xaa in position 15 is any amino acid
  Variant (16)..(16): Xaa in position 16 is Phe or Leu
  Variant (17)..(17): Xaa in position 17 is any amino acid
  Variant (18)..(18): Xaa in position 18 is Glu, His, Lys or Arg
IXXXIXXFXKXXXYXXXX

SEQ ID NO: 15673 - DNA, 1422 bp, Saccharomyces cerevisiae
  CDS (1)..(1422)
atgcgatcttatatgcagattcttcaaaaatttgccaaatttattgggccagggatattagtcagtgtggcttatatggacccaggaaattatgccactagtgtttccggtggtgctcaatacaaatataccttattattctctatttttatatccaacatttttgccgtacttttgcaatgtctctgtgtgaagctgggtactatcactggctatgatttggctgaaaactgtcgtcataatttgcctaaaaagctaaactataccctttaccttttcgctgaagtggcaatcattgctactgatctggccgaggttgtaggcactgccatcgctttacaaattcttttcaaaataccactaacttggggtgtcttattaacggtgctagatgttttggtaattttaatgttctacacaccaaacggccagtccttaaaaaaagttagggttttcgaatttggcgttgggattttggtcattggaacttgcatttgctttgttttggagctgtttaaagtttcaatcccagacaaagctgaattgtttaaagggtttttgccttcaaatatcatttttaaggaacaacaagctctttacatttcattgggtatcttaggtgccactgtgatgcctcattcattatacttgggctcatccattgttaaaccaagattgcacgattacgatttgaagaaatacggtaaggttaatgcccgcccaagtttaagcgctataaaatatacgttaaactatgcgtacgctgaactaatcatttctttgttcttaattgccacctttgttaattccgctattttaattgttgcaggtgctactttatcaggccaacctgaggcagaggatgctgatttgttatctatttacaaattactggtccactacatatctcctgcggcagggttaatctttgcattggccatgttatgttctggtcaatctgccggtatcatctgtacacttgccgggcaaatcgtttctgagggatttttacagtggtctttaccaccttgggccacaagattgtgcaccagattgattgccattgtaccatgtttatttgttactttaaccatgggggaaaagggaatttcagatattttgaatttttctcaagtggtcttgtccttaattttaccaatcgtatccgctcctttaatttattttaccgcaaatagaaagttgatggttgttcatgacgaaaatggtgtggtaagagcacctgccgatgttaacgccattgctgatgaaaccactccattgaactccaagcacagtaaaatagttgattttactaacagtcgtttgttgacctatacctctgttttcgtatgggctttaatcgggagcttgaattgctatttggtgatttcctatctcttaggtgccgacatccatttttaa

SEQ ID NO: 15674 - protein, 473 aa, Saccharomyces cerevisiae; identical to SEQ ID NO: 8662

SEQ ID NO: 15675 - DNA, 1383 bp, Bradyrhizobium sp. ORS278; identical to SEQ ID NO: 8663
  CDS (1)..(1383): transl_table=11

SEQ ID NO: 15676 - protein, 460 aa, Bradyrhizobium sp. ORS278; identical to SEQ ID NO: 8664

SEQ ID NO: 15677 - DNA, 1653 bp, Oryza sativa (japonica cultivar-group); identical to SEQ ID NO: 8665
  CDS (1)..(1653)

SEQ ID NO: 15678 - protein, 550 aa, Oryza sativa (japonica cultivar-group); identical to SEQ ID NO: 8666

SEQ ID NO: 15679 - DNA, 1638 bp, Oryza sativa (japonica cultivar-group); identical to SEQ ID NO: 8667
  CDS (1)..(1638)

SEQ ID NO: 15680 - protein, 545 aa, Oryza sativa (japonica cultivar-group); identical to SEQ ID NO: 8668

SEQ ID NO: 15681 - DNA, 1653 bp, Oryza sativa (japonica cultivar-group); identical to SEQ ID NO: 8669
  CDS (1)..(1653)

SEQ ID NO: 15682 - protein, 550 aa, Oryza sativa (japonica cultivar-group); identical to SEQ ID NO: 8670

SEQ ID NO: 15683 - DNA, 1617 bp, Oryza sativa (japonica cultivar-group); identical to SEQ ID NO: 8671
  CDS (1)..(1617)

SEQ ID NO: 15684 - protein, 538 aa, Oryza sativa (japonica cultivar-group); identical to SEQ ID NO: 8672

SEQ ID NO: 15685 - DNA, 1557 bp, Oryza sativa (japonica cultivar-group); identical to SEQ ID NO: 8673
  CDS (1)..(1557)

SEQ ID NO: 15686 - protein, 518 aa, Oryza sativa (japonica cultivar-group); identical to SEQ ID NO: 8674

SEQ ID NO: 15687 - DNA, 1626 bp, Oryza sativa (japonica cultivar-group); identical to SEQ ID NO: 8675
  CDS (1)..(1626)

SEQ ID NO: 15688 - protein, 541 aa, Oryza sativa (japonica cultivar-group); identical to SEQ ID NO: 8676

SEQ ID NO: 15689 - DNA, 1257 bp, Pseudomonas aeruginosa PAO1; identical to SEQ ID NO: 8677
  CDS (1)..(1257): transl_table=11

SEQ ID NO: 15690 - protein, 418 aa, Pseudomonas aeruginosa PAO1; identical to SEQ ID NO: 8678

SEQ ID NO: 15691 - DNA, 1239 bp, Escherichia coli O157:H7 EDL933; identical to SEQ ID NO: 8679
  CDS (1)..(1239): transl_table=11
  misc_feature (1153)..(1153): s is g or c
  misc_feature (1155)..(1155): s is g or c

SEQ ID NO: 15692 - protein, 412 aa, Escherichia coli O157:H7 EDL933; identical to SEQ ID NO: 8680
  misc_feature (385)..(385): The Xaa at location 385 stands for Arg, or Gly.

SEQ ID NO: 15693 - DNA, 1290 bp, Mycobacterium tuberculosis CDC1551; identical to SEQ ID NO: 8681
  CDS (1)..(1290): transl_table=11

SEQ ID NO: 15694 - protein, 429 aa, Mycobacterium tuberculosis CDC1551; identical to SEQ ID NO: 8682

SEQ ID NO: 15695 - DNA, 1254 bp, Clostridium acetobutylicum ATCC 824; identical to SEQ ID NO: 8683
  CDS (1)..(1254): transl_table=11

SEQ ID NO: 15696 - protein, 417 aa, Clostridium acetobutylicum ATCC 824; identical to SEQ ID NO: 8684

SEQ ID NO: 15697 - DNA, 1371 bp, Agrobacterium tumefaciens str. C58; identical to SEQ ID NO: 8685
  CDS (1)..(1371): transl_table=11

SEQ ID NO: 15698 - protein, 456 aa, Agrobacterium tumefaciens str. C58; identical to SEQ ID NO: 8686

SEQ ID NO: 15699 - DNA, 1263 bp, Thermoanaerobacter tengcongensis MB4; identical to SEQ ID NO: 8687
  CDS (1)..(1263): transl_table=11

SEQ ID NO: 15700 - protein, 420 aa, Thermoanaerobacter tengcongensis MB4; identical to SEQ ID NO: 8688

SEQ ID NO: 15701 - DNA, 1260 bp, Chlorobium tepidum TLS; identical to SEQ ID NO: 8689
  CDS (1)..(1260): transl_table=11

SEQ ID NO: 15702 - protein, 419 aa, Chlorobium tepidum TLS; identical to SEQ ID NO: 8690

SEQ ID NO: 15703 - DNA, 1569 bp, Streptococcus agalactiae 2603V/R; identical to SEQ ID NO: 8691
  CDS (1)..(1569): transl_table=11

SEQ ID NO: 15704 - protein, 522 aa, Streptococcus agalactiae 2603V/R; identical to SEQ ID NO: 8692

SEQ ID NO: 15705 - DNA, 1368 bp, Bifidobacterium longum NCC2705; identical to SEQ ID NO: 8693
  CDS (1)..(1368): transl_table=11

SEQ ID NO: 15706 - protein, 455 aa, Bifidobacterium longum NCC2705; identical to SEQ ID NO: 8694

SEQ ID NO: 15707 - DNA, 1239 bp, Shigella flexneri 2a str. 301; identical to SEQ ID NO: 8695
  CDS (1)..(1239): transl_table=11

SEQ ID NO: 15708 - protein, 412 aa, Shigella flexneri 2a str. 301; identical to SEQ ID NO: 8696

SEQ ID NO: 15709 - DNA, 1341 bp, Streptococcus mutans UA159; identical to SEQ ID NO: 8697
  CDS (1)..(1341): transl_table=11

SEQ ID NO: 15710 - protein, 446 aa, Streptococcus mutans UA159; identical to SEQ ID NO: 8698

SEQ ID NO: 15711 - DNA, 1341 bp, Streptococcus agalactiae NEM316; identical to SEQ ID NO: 8699
  CDS (1)..(1341): transl_table=11

SEQ ID NO: 15712 - protein, 446 aa, Streptococcus agalactiae NEM316; identical to SEQ ID NO: 8700

SEQ ID NO: 15713 - DNA, 1326 bp, Lactobacillus plantarum WCFS1; identical to SEQ ID NO: 8701
  CDS (1)..(1326): transl_table=11

SEQ ID NO: 15714 - protein, 441 aa, Lactobacillus plantarum WCFS1; identical to SEQ ID NO: 8702

SEQ ID NO: 15715 - DNA, 1593 bp, Lactobacillus plantarum WCFS1; identical to SEQ ID NO: 8703
  CDS (1)..(1593): transl_table=11

SEQ ID NO: 15716 - protein, 530 aa, Lactobacillus plantarum WCFS1; identical to SEQ ID NO: 8704

SEQ ID NO: 15717 - DNA, 1233 bp, Pseudomonas syringae pv. tomato str. DC3000; identical to SEQ ID NO: 8705
  CDS (1)..(1233): transl_table=11

SEQ ID NO: 15718 - protein, 410 aa, Pseudomonas syringae pv. tomato str. DC3000; identical to SEQ ID NO: 8706

SEQ ID NO: 15719 - DNA, 1257 bp, Bacteroides thetaiotaomicron VPI-5482; identical to SEQ ID NO: 8707
  CDS (1)..(1257): transl_table=11

SEQ ID NO: 15720 - protein, 418 aa, Bacteroides thetaiotaomicron VPI-5482; identical to SEQ ID NO: 8708

SEQ ID NO: 15721 - DNA, 1599 bp, Enterococcus faecalis V583; identical to SEQ ID NO: 8709
  CDS (1)..(1599): transl_table=11

SEQ ID NO: 15722 - protein, 532 aa, Enterococcus faecalis V583; identical to SEQ ID NO: 8710

SEQ ID NO: 15723 - DNA, 1362 bp, Enterococcus faecalis V583; identical to SEQ ID NO: 8711
  CDS (1)..(1362): transl_table=11

SEQ ID NO: 15724 - protein, 453 aa, Enterococcus faecalis V583; identical to SEQ ID NO: 8712

SEQ ID NO: 15725 - DNA, 1296 bp, Bacillus cereus ATCC 14579; identical to SEQ ID NO: 8713
  CDS (1)..(1296): transl_table=11

SEQ ID NO: 15726 - protein, 431 aa, Bacillus cereus ATCC 14579; identical to SEQ ID NO: 8714

SEQ ID NO: 15727 - DNA, 1239 bp, Shigella flexneri 2a str. 2457T; identical to SEQ ID NO: 8715
  CDS (1)..(1239): transl_table=11

SEQ ID NO: 15728 - protein, 412 aa, Shigella flexneri 2a str. 2457T; identical to SEQ ID NO: 8716

SEQ ID NO: 15729 - DNA, 1296 bp, Bacillus anthracis str. Ames; identical to SEQ ID NO: 8717
  CDS (1)..(1296): transl_table=11

SEQ ID NO: 15730 - protein, 431 aa, Bacillus anthracis str. Ames; identical to SEQ ID NO: 8718

SEQ ID NO: 15731 - DNA, 1197 bp, Corynebacterium diphtheriae; identical to SEQ ID NO: 8719
  CDS (1)..(1197): transl_table=11

SEQ ID NO: 15732 - protein, 398 aa, Corynebacterium diphtheriae; identical to SEQ ID NO: 8720

SEQ ID NO: 15733 - DNA, 1341 bp, Wigglesworthia glossinidia endosymbiont of Glossina brevipalpis; identical to SEQ ID NO: 8721
  CDS (1)..(1341): transl_table=11

SEQ ID NO: 15734 - protein, 446 aa, Wigglesworthia glossinidia endosymbiont of Glossina brevipalpis; identical to SEQ ID NO: 8722

SEQ ID NO: 15735 - DNA, 1239 bp, Candidatus Blochmannia floridanus; identical to SEQ ID NO: 8723
  CDS (1)..(1239): transl_table=11

SEQ ID NO: 15736 - protein, 412 aa, Candidatus Blochmannia floridanus; identical to SEQ ID NO: 8724

SEQ ID NO: 15737 - DNA, 1305 bp, Chromobacterium violaceum ATCC 12472; identical to SEQ ID NO: 8725
  CDS (1)..(1305): transl_table=11

SEQ ID NO: 15738 - protein, 434 aa, Chromobacterium violaceum ATCC 12472; identical to SEQ ID NO: 8726

SEQ ID NO: 15739 - DNA, 1374 bp, Rhodopseudomonas palustris CGA009; identical to SEQ ID NO: 8727
  CDS (1)..(1374): transl_table=11

SEQ ID NO: 15740 - protein, 457 aa, Rhodopseudomonas palustris CGA009; identical to SEQ ID NO: 8728

SEQ ID NO: 15741 - DNA, 1245 bp, Gordonia westfalica; identical to SEQ ID NO: 8729
  CDS (1)..(1245): transl_table=11

SEQ ID NO: 15742 - protein, 414 aa, Gordonia westfalica; identical to SEQ ID NO: 8730

SEQ ID NO: 15743 - DNA, 1278 bp, Mycobacterium avium subsp. paratuberculosis K-10; identical to SEQ ID NO: 8731
  CDS (1)..(1278): transl_table=11

SEQ ID NO: 15744 - protein, 425 aa, Mycobacterium avium subsp. paratuberculosis K-10; identical to SEQ ID NO: 8732

SEQ ID NO: 15745 - DNA, 1500 bp, Lactobacillus johnsonii NCC 533; identical to SEQ ID NO: 8733
  CDS (1)..(1500): transl_table=11

SEQ ID NO: 15746 - protein, 499 aa, Lactobacillus johnsonii NCC 533; identical to SEQ ID NO: 8734

SEQ ID NO: 15747 - DNA, 1296 bp, Bacillus cereus ATCC 10987; identical to SEQ ID NO: 8735
  CDS (1)..(1296): transl_table=11

SEQ ID NO: 15748 - protein, 431 aa, Bacillus cereus ATCC 10987; identical to SEQ ID NO: 8736

SEQ ID NO: 15749 - DNA, 1230 bp, Yersinia pestis biovar Microtus str. 91001; identical to SEQ ID NO: 8737
  CDS (1)..(1230): transl_table=11

SEQ ID NO: 15750 - protein, 409 aa, Yersinia pestis biovar Microtus str. 91001; identical to SEQ ID NO: 8738

SEQ ID NO: 15751 - DNA, 1416 bp, Candida glabrata CBS 138; identical to SEQ ID NO: 8739
  CDS (1)..(1416)

SEQ ID NO: 15752 - protein, 471 aa, Candida glabrata CBS 138; identical to SEQ ID NO: 8740

SEQ ID NO: 15753 - DNA, 1641 bp, Candida glabrata CBS 138; identical to SEQ ID NO: 8741
  CDS (1)..(1641)

SEQ ID NO: 15754 - protein, 546 aa, Candida glabrata CBS 138; identical to SEQ ID NO: 8742

SEQ ID NO: 15755 - DNA, 1626 bp, Candida glabrata CBS 138; identical to SEQ ID NO: 8743
  CDS (1)..(1626)

SEQ ID NO: 15756 - protein, 541 aa, Candida glabrata CBS 138; identical to SEQ ID NO: 8744

SEQ ID NO: 15757 - DNA, 1740 bp, Kluyveromyces lactis NRRL Y-1140; identical to SEQ ID NO: 8745
  CDS (1)..(1740)

SEQ ID NO: 15758 - protein, 579 aa, Kluyveromyces lactis NRRL Y-1140; identical to SEQ ID NO: 8746

SEQ ID NO: 15759 - DNA, 1668 bp, Kluyveromyces lactis NRRL Y-1140; identical to SEQ ID NO: 8747
  CDS (1)..(1668)

SEQ ID NO: 15760 - protein, 555 aa, Kluyveromyces lactis NRRL Y-1140; identical to SEQ ID NO: 8748

SEQ ID NO: 15761 - DNA, 1431 bp, Kluyveromyces lactis NRRL Y-1140; identical to SEQ ID NO: 8749
  CDS (1)..(1431)

SEQ ID NO: 15762 - protein, 476 aa, Kluyveromyces lactis NRRL Y-1140; identical to SEQ ID NO: 8750

SEQ ID NO: 15763 - DNA, 1986 bp, Debaryomyces hansenii CBS767; identical to SEQ ID NO: 8751
  CDS (1)..(1986)

SEQ ID NO: 15764 - protein, 661 aa, Debaryomyces hansenii CBS767; identical to SEQ ID NO: 8752

SEQ ID NO: 15765 - DNA, 1557 bp, Debaryomyces hansenii CBS767; identical to SEQ ID NO: 8753
  CDS (1)..(1557)

SEQ ID NO: 15766 - protein, 518 aa, Debaryomyces hansenii CBS767; identical to SEQ ID NO: 8754

SEQ ID NO: 15767 - DNA, 1710 bp, Yarrowia lipolytica CLIB122; identical to SEQ ID NO: 8755
  CDS (1)..(1710)

SEQ ID NO: 15768 - protein, 569 aa, Yarrowia lipolytica CLIB122; identical to SEQ ID NO: 8756

SEQ ID NO: 15769 - DNA, 1914 bp, Yarrowia lipolytica CLIB122; identical to SEQ ID NO: 8757
  CDS (1)..(1914)

SEQ ID NO: 15770 - protein, 637 aa, Yarrowia lipolytica CLIB122; identical to SEQ ID NO: 8758

SEQ ID NO: 15771 - DNA, 1794 bp, Aspergillus nidulans FGSC A4; identical to SEQ ID NO: 8759
  CDS (1)..(1794)

SEQ ID NO: 15772 - protein, 597 aa, Aspergillus nidulans FGSC A4; identical to SEQ ID NO: 8760

SEQ ID NO: 15773 - DNA, 1755 bp, Candida albicans SC5314; identical to SEQ ID NO: 8761
  CDS (1)..(1755): transl_table=12

SEQ ID NO: 15774 - protein, 584 aa, Candida albicans SC5314; identical to SEQ ID NO: 8762

SEQ ID NO: 15775 - DNA, 1545 bp, Candida albicans SC5314; identical to SEQ ID NO: 8763
  CDS (1)..(1545): transl_table=12

SEQ ID NO: 15776 - protein, 514 aa, Candida albicans SC5314; identical to SEQ ID NO: 8764

SEQ ID NO: 15777 - DNA, 2016 bp, Candida albicans SC5314; identical to SEQ ID NO: 8765
  CDS (1)..(2016): transl_table=12

SEQ ID NO: 15778 - protein, 671 aa, Candida albicans SC5314; identical to SEQ ID NO: 8766

SEQ ID NO: 15779 - DNA, 1734 bp, Candida albicans SC5314; identical to SEQ ID NO: 8767
  CDS (1)..(1734): transl_table=12

SEQ ID NO: 15780 - protein, 577 aa, Candida albicans SC5314; identical to SEQ ID NO: 8768

SEQ ID NO: 15781 - DNA, 1728 bp, Candida albicans SC5314; identical to SEQ ID NO: 8769
  CDS (1)..(1728): transl_table=12

SEQ ID NO: 15782 - protein, 575 aa, Candida albicans SC5314; identical to SEQ ID NO: 8770

SEQ ID NO: 15783 - DNA, 1227 bp, Mycobacterium sp. JLS; identical to SEQ ID NO: 8771
  CDS (1)..(1227): transl_table=11

SEQ ID NO: 15784 - protein, 408 aa, Mycobacterium sp. JLS; identical to SEQ ID NO: 8772

SEQ ID NO: 15785 - DNA, 1350 bp, Burkholderia vietnamiensis G4; identical to SEQ ID NO: 8773
  CDS (1)..(1350): transl_table=11

SEQ ID NO: 15786 - protein, 449 aa, Burkholderia vietnamiensis G4; identical to SEQ ID NO: 8774

SEQ ID NO: 15787 - DNA, 1308 bp, Burkholderia vietnamiensis G4; identical to SEQ ID NO: 8775
  CDS (1)..(1308): transl_table=11

SEQ ID NO: 15788 - protein, 435 aa, Burkholderia vietnamiensis G4; identical to SEQ ID NO: 8776

SEQ ID NO: 15789 - DNA, 1296 bp, Bacillus thuringiensis serovar konkukian str. 97-27; identical to SEQ ID NO: 8777
  CDS (1)..(1296): transl_table=11

SEQ ID NO: 15790 - protein, 431 aa, Bacillus thuringiensis serovar konkukian str. 97-27; identical to SEQ ID NO: 8778

SEQ ID NO: 15791 - DNA, 1233 bp, Erwinia carotovora subsp. atroseptica SCRI1043; identical to SEQ ID NO: 8779
  CDS (1)..(1233): transl_table=11

SEQ ID NO: 15792 - protein, 410 aa, Erwinia carotovora subsp. atroseptica SCRI1043; identical to SEQ ID NO: 8780

SEQ ID NO: 15793 - DNA, 1212 bp, Propionibacterium acnes KPA171202; identical to SEQ ID NO: 8781
  CDS (1)..(1212): transl_table=11

SEQ ID NO: 15794 - protein, 403 aa, Propionibacterium acnes KPA171202; identical to SEQ ID NO: 8782

SEQ ID NO: 15795 - DNA, 1272 bp, Leifsonia xyli subsp. xyli str. CTCB07; identical to SEQ ID NO: 8783
  CDS (1)..(1272): transl_table=11

SEQ ID NO: 15796 - protein, 423 aa, Leifsonia xyli subsp. xyli str. CTCB07; identical to SEQ ID NO: 8784

SEQ ID NO: 15797 - DNA, 1296 bp, Bacillus cereus E33L; identical to SEQ ID NO: 8785
  CDS (1)..(1296): transl_table=11

SEQ ID NO: 15798 - protein, 431 aa, Bacillus cereus E33L; identical to SEQ ID NO: 8786

SEQ ID NO: 15799 - DNA, 1281 bp, Bacillus licheniformis ATCC 14580; identical to SEQ ID NO: 8787
  CDS (1)..(1281): transl_table=11

SEQ ID NO: 15800 - protein, 426 aa, Bacillus licheniformis ATCC 14580; identical to SEQ ID NO: 8788

SEQ ID NO: 15801 - DNA, 1296 bp, Burkholderia mallei ATCC 23344; identical to SEQ ID NO: 8789
  CDS (1)..(1296): transl_table=11

SEQ ID NO: 15802 - protein, 431 aa, Burkholderia mallei ATCC 23344; identical to SEQ ID NO: 8790

SEQ ID NO: 15803 - DNA, 1308 bp, Burkholderia pseudomallei K96243; identical to SEQ ID NO: 8791
  CDS (1)..(1308): transl_table=11

SEQ ID NO: 15804 - protein, 435 aa, Burkholderia pseudomallei K96243; identical to SEQ ID NO: 8792

SEQ ID NO: 15805 - DNA, 1296 bp, Burkholderia pseudomallei K96243; identical to SEQ ID NO: 8793
  CDS (1)..(1296): transl_table=11

SEQ ID NO: 15806 - protein, 431 aa, Burkholderia pseudomallei K96243; identical to SEQ ID NO: 8794

SEQ ID NO: 15807 - DNA, 1320 bp, Pseudomonas syringae pv. syringae B728a; identical to SEQ ID NO: 8795
  CDS (1)..(1320): transl_table=11

SEQ ID NO: 15808 - protein, 439 aa, Pseudomonas syringae pv. syringae B728a; identical to SEQ ID NO: 8796

SEQ ID NO: 15809 - DNA, 1320 bp, Pseudomonas fluorescens Pf-5; identical to SEQ ID NO: 8797
  CDS (1)..(1320): transl_table=11

SEQ ID NO: 15810 - protein, 439 aa, Pseudomonas fluorescens Pf-5; identical to SEQ ID NO: 8798

SEQ ID NO: 15811 - DNA, 1320 bp, Pseudomonas syringae pv. phaseolicola 1448A; identical to SEQ ID NO: 8799
  CDS (1)..(1320): transl_table=11

SEQ ID NO: 15812 - protein, 439 aa, Pseudomonas syringae pv. phaseolicola 1448A; identical to SEQ ID NO: 8800

SEQ ID NO: 15813 - DNA, 1308 bp, Ralstonia eutropha JMP134; identical to SEQ ID NO: 8801
  CDS (1)..(1308): transl_table=11

SEQ ID NO: 15814 - protein, 435 aa, Ralstonia eutropha JMP134; identical to SEQ ID NO: 8802

SEQ ID NO: 15815 - DNA, 1338 bp, Pseudomonas fluorescens PfO-1; identical to SEQ ID NO: 8803
  CDS (1)..(1338): transl_table=11

SEQ ID NO: 15816 - protein, 445 aa, Pseudomonas fluorescens PfO-1; identical to SEQ ID NO: 8804

SEQ ID NO: 15817 - DNA, 1197 bp, Carboxydothermus hydrogenoformans Z-2901; identical to SEQ ID NO: 8805
  CDS (1)..(1197): transl_table=11

SEQ ID NO: 15818 - protein, 398 aa, Carboxydothermus hydrogenoformans Z-2901; identical to SEQ ID NO: 8806

SEQ ID NO: 15819 - DNA, 1299 bp, Burkholderia sp. 383; identical to SEQ ID NO: 8807
  CDS (1)..(1299): transl_table=11

SEQ ID NO: 15820 - protein, 432 aa, Burkholderia sp. 383; identical to SEQ ID NO: 8808

SEQ ID NO: 15821 - DNA, 1308 bp, Burkholderia sp. 383; identical to SEQ ID NO: 8809
  CDS (1)..(1308): transl_table=11

SEQ ID NO: 15822 - protein, 435 aa, Burkholderia sp. 383; identical to SEQ ID NO: 8810

SEQ ID NO: 15823 - DNA, 1317 bp, Burkholderia sp. 383; identical to SEQ ID NO: 8811
  CDS (1)..(1317): transl_table=11

SEQ ID NO: 15824 - protein, 438 aa, Burkholderia sp. 383; identical to SEQ ID NO: 8812

SEQ ID NO: 15825 - DNA, 1350 bp, Burkholderia thailandensis E264; identical to SEQ ID NO: 8813
  CDS (1)..(1350): transl_table=11

SEQ ID NO: 15826 - protein, 449 aa, Burkholderia thailandensis E264; identical to SEQ ID NO: 8814

SEQ ID NO: 15827 - DNA, 1563 bp, Burkholderia thailandensis E264; identical to SEQ ID NO: 8815
  CDS (1)..(1563): transl_table=11

SEQ ID NO: 15828 - protein, 520 aa, Burkholderia thailandensis E264; identical to SEQ ID NO: 8816

SEQ ID NO: 15829 - DNA, 1359 bp, Burkholderia thailandensis E264; identical to SEQ ID NO: 8817
  CDS (1)..(1359): transl_table=11

SEQ ID NO: 15830 - protein, 452 aa, Burkholderia thailandensis E264; identical to SEQ ID NO: 8818

SEQ ID NO: 15831 - DNA, 1365 bp, Burkholderia xenovorans LB400; identical to SEQ ID NO: 8819
  CDS (1)..(1365): transl_table=11

SEQ ID NO: 15832 - protein, 454 aa, Burkholderia xenovorans LB400; identical to SEQ ID NO: 8820

SEQ ID NO: 15833 - DNA, 1347 bp, Burkholderia xenovorans LB400; identical to SEQ ID NO: 8821
  CDS (1)..(1347): transl_table=11

SEQ ID NO: 15834 - protein, 448 aa, Burkholderia xenovorans LB400; identical to SEQ ID NO: 8822

SEQ ID NO: 15835 - DNA, 1281 bp, Acidobacteria bacterium Ellin345; identical to SEQ ID NO: 8823
  CDS (1)..(1281): transl_table=11

SEQ ID NO: 15836 - protein, 426 aa, Acidobacteria bacterium Ellin345; identical to SEQ ID NO: 8824

SEQ ID NO: 15837 - DNA, 1266 bp, Rubrobacter xylanophilus DSM 9941; identical to SEQ ID NO: 8825
  CDS (1)..(1266): transl_table=11

SEQ ID NO: 15838 - protein, 421 aa, Rubrobacter xylanophilus DSM 9941; identical to SEQ ID NO: 8826

SEQ ID NO: 15839 - DNA, 1347 bp, Mesorhizobium sp. BNC1; identical to SEQ ID NO: 8827
  CDS (1)..(1347): transl_table=11

SEQ ID NO: 15840 - protein, 448 aa, Mesorhizobium sp. BNC1; identical to SEQ ID NO: 8828

SEQ ID NO: 15841 - DNA, 1263 bp, Rhodococcus sp. RHA1; identical to SEQ ID NO: 8829
  CDS (1)..(1263): transl_table=11

SEQ ID NO: 15842 - protein, 420 aa, Rhodococcus sp. RHA1; identical to SEQ ID NO: 8830

SEQ ID NO: 15843 - DNA, 1341 bp, Rhizobium leguminosarum bv. viciae 3841; identical to SEQ ID NO: 8831
  CDS (1)..(1341): transl_table=11

SEQ ID NO: 15844 - protein, 446 aa, Rhizobium leguminosarum bv. viciae 3841; identical to SEQ ID NO: 8832

SEQ ID NO: 15845 - DNA, 1317 bp, Pseudomonas aeruginosa UCBPP-PA14; identical to SEQ ID NO: 8833
  CDS (1)..(1317): transl_table=11

SEQ ID NO: 15846 - protein, 438 aa, Pseudomonas aeruginosa UCBPP-PA14; identical to SEQ ID NO: 8834

SEQ ID NO: 15847 - DNA, 1257 bp, Pseudomonas aeruginosa UCBPP-PA14; identical to SEQ ID NO: 8835
  CDS (1)..(1257): transl_table=11

SEQ ID NO: 15848 - protein, 418 aa, Pseudomonas aeruginosa UCBPP-PA14; identical to SEQ ID NO: 8836

SEQ ID NO: 15849 - DNA, 1602 bp, Pediococcus pentosaceus ATCC 25745; identical to SEQ ID NO: 8837
  CDS (1)..(1602): transl_table=11

SEQ ID NO: 15850 - protein, 533 aa, Pediococcus pentosaceus ATCC 25745; identical to SEQ ID NO: 8838

SEQ ID NO: 15851 - DNA, 1344 bp, Pediococcus pentosaceus ATCC 25745; identical to SEQ ID NO: 8839
  CDS (1)..(1344): transl_table=11

SEQ ID NO: 15852 - protein, 447 aa, Pediococcus pentosaceus ATCC 25745; identical to SEQ ID NO: 8840

SEQ ID NO: 15853 - DNA, 1335 bp, Oenococcus oeni PSU-1; identical to SEQ ID NO: 8841
  CDS (1)..(1335): transl_table=11

SEQ ID NO: 15854 - protein, 444 aa, Oenococcus oeni PSU-1; identical to SEQ ID NO: 8842

SEQ ID NO: 15855 - DNA, 1599 bp, Oenococcus oeni PSU-1; identical to SEQ ID NO: 8843
  CDS (1)..(1599): transl_table=11

SEQ ID NO: 15856 - protein, 532 aa, Oenococcus oeni PSU-1; identical to SEQ ID NO: 8844

SEQ ID NO: 15857 - DNA, 1395 bp, Leuconostoc mesenteroides subsp. mesenteroides ATCC 8293; identical to SEQ ID NO: 8845
  CDS (1)..(1395): transl_table=11

SEQ ID NO: 15858 - protein, 464 aa, Leuconostoc mesenteroides subsp. mesenteroides ATCC 8293; identical to SEQ ID NO: 8846

SEQ ID NO: 15859 - DNA, 1914 bp, Solibacter usitatus Ellin6076; identical to SEQ ID NO: 8847
  CDS (1)..(1914): transl_table=11

SEQ ID NO: 15860 - protein, 637 aa, Solibacter usitatus Ellin6076; identical to SEQ ID NO: 8848

SEQ ID NO: 15861 - DNA, 1227 bp, Mycobacterium avium 104; identical to SEQ ID NO: 8849
  CDS (1)..(1227): transl_table=11

SEQ ID NO: 15862 - protein, 408 aa, Mycobacterium avium 104; identical to SEQ ID NO: 8850

SEQ ID NO: 15863 - DNA, 1224 bp, Mycobacterium smegmatis str. MC2 155; identical to SEQ ID NO: 8851
  CDS (1)..(1224): transl_table=11

SEQ ID NO: 15864 - protein, 407 aa, Mycobacterium smegmatis str. MC2 155; identical to SEQ ID NO: 8852

SEQ ID NO: 15865 - DNA, 1227 bp, Mycobacterium sp. KMS; identical to SEQ ID NO: 8853
  CDS (1)..(1227): transl_table=11

SEQ ID NO: 15866 - protein, 408 aa, Mycobacterium sp. KMS; identical to SEQ ID NO: 8854

SEQ ID NO: 15867 - DNA, 1347 bp, Magnetospirillum magnetotacticum MS-1; identical to SEQ ID NO: 8855
  CDS (1)..(1347): transl_table=11

SEQ ID NO: 15868 - protein, 448 aa, Magnetospirillum magnetotacticum MS-1; identical to SEQ ID NO: 8856

SEQ ID NO: 15869 - DNA, 1308 bp, Nostoc punctiforme PCC 73102; identical to SEQ ID NO: 8857
  CDS (1)..(1308): transl_table=11

SEQ ID NO: 15870 - protein, 435 aa, Nostoc punctiforme PCC 73102; identical to SEQ ID NO: 8858

SEQ ID NO: 15871 - DNA, 1323 bp, Bifidobacterium longum DJO10A; identical to SEQ ID NO: 8859
  CDS (1)..(1323): transl_table=11

SEQ ID NO: 15872 - protein, 440 aa, Bifidobacterium longum DJO10A; identical to SEQ ID NO: 8860

SEQ ID NO: 15873 - DNA, 1296 bp, Bacillus cereus G9241; identical to SEQ ID NO: 8861
  CDS (1)..(1296): transl_table=11

SEQ ID NO: 15874 - protein, 431 aa, Bacillus cereus G9241; identical to SEQ ID NO: 8862

SEQ ID NO: 15875 - DNA, 1221 bp, Exiguobacterium sibiricum 255-15; identical to SEQ ID NO: 8863
  CDS (1)..(1221): transl_table=11

SEQ ID NO: 15876 - protein, 406 aa, Exiguobacterium sibiricum 255-15; identical to SEQ ID NO: 8864

SEQ ID NO: 15877 - DNA, 1257 bp, Kineococcus radiotolerans SRS30216; identical to SEQ ID NO: 8865
  CDS (1)..(1257): transl_table=11

SEQ ID NO: 15878 - protein, 418 aa, Kineococcus radiotolerans SRS30216; identical to SEQ ID NO: 8866

SEQ ID NO: 15879 - DNA, 1377 bp, Xylella fastidiosa Dixon; identical to SEQ ID NO: 8867
  CDS (1)..(1377): transl_table=11

SEQ ID NO: 15880 - protein, 458 aa, Xylella fastidiosa Dixon; identical to SEQ ID NO: 8868

SEQ ID NO: 15881 - DNA, 1473 bp, Xylella fastidiosa Ann-1; identical to SEQ ID NO: 8869
  CDS (1)..(1473): transl_table=11

SEQ ID NO: 15882 - protein, 490 aa, Xylella fastidiosa Ann-1; identical to SEQ ID NO: 8870

SEQ ID NO: 15883 - DNA, 1242 bp, Photobacterium sp. SKA34; identical to SEQ ID NO: 8871
  CDS (1)..(1242): transl_table=11

SEQ ID NO: 15884 - protein, 413 aa, Photobacterium sp. SKA34; identical to SEQ ID NO: 8872

SEQ ID NO: 15885 - DNA, 1275 bp, marine gamma proteobacterium HTCC2080; identical to SEQ ID NO: 8873
  CDS (1)..(1275): transl_table=11

SEQ ID NO: 15886 - protein, 424 aa, marine gamma proteobacterium HTCC2080; identical to SEQ ID NO: 8874

SEQ ID NO: 15887 - DNA, 1623 bp, Ostreococcus tauri; identical to SEQ ID NO: 8875
  CDS (1)..(1623)

SEQ ID NO: 15888 - protein, 540 aa, Ostreococcus tauri; identical to SEQ ID NO: 8876

SEQ ID NO: 15889 - DNA, 1596 bp, Medicago truncatula; identical to SEQ ID NO: 8877
  CDS (1)..(1596)

SEQ ID NO: 15890 - protein, 531 aa, Medicago truncatula; identical to SEQ ID NO: 8878

SEQ ID NO: 15891 - DNA, 1629 bp, Medicago truncatula; identical to SEQ ID NO: 8879
  CDS (1)..(1629)

SEQ ID NO: 15892 - protein, 542 aa, Medicago truncatula; identical to SEQ ID NO: 8880

SEQ ID NO: 15893 - DNA, 1557 bp, Oryza sativa subsp; identical to SEQ ID NO: 8881
  CDS (1)..(1557)

SEQ ID NO: 15894 - protein, 518 aa, Oryza sativa subsp; identical to SEQ ID NO: 8882

SEQ ID NO: 15895 - DNA, 1731 bp, Aspergillus oryzae; identical to SEQ ID NO: 8883
  CDS (1)..(1731)

SEQ ID NO: 15896 - protein, 576 aa, Aspergillus oryzae; identical to SEQ ID NO: 8884

SEQ ID NO: 15897 - DNA, 1966 bp, Acanthopanax sciadophylloides; identical to SEQ ID NO: 8885
  CDS (160)..(1773)

SEQ ID NO: 15898 - protein, 537 aa, Acanthopanax sciadophylloides; identical to SEQ ID NO: 8886

SEQ ID NO: 15899 - DNA, 1967 bp, Oryza sativa; identical to SEQ ID NO: 8887
  CDS (63)..(1616)

SEQ ID NO: 15900 - protein, 517 aa, Oryza sativa; identical to SEQ ID NO: 8888

SEQ ID NO: 15901 - DNA, 2090 bp, Malus baccata; identical to SEQ ID NO: 8889
  CDS (71)..(1726)

SEQ ID NO: 15902 - protein, 551 aa, Malus baccata; identical to SEQ ID NO: 8890

SEQ ID NO: 15903 - DNA, 1849 bp, Glycine max; identical to SEQ ID NO: 8891
  CDS (96)..(1646)

SEQ ID NO: 15904 - protein, 516 aa, Glycine max; identical to SEQ ID NO: 8892

SEQ ID NO: 15905 - DNA, 1691 bp, Thlaspi japonicum; identical to SEQ ID NO: 8893
  CDS (81)..(1613)

SEQ ID NO: 15906 - protein, 510 aa, Thlaspi japonicum; identical to SEQ ID NO: 8894

SEQ ID NO: 15907 - DNA, 1365 bp, Enterococcus faecalis; identical to SEQ ID NO: 8895
  CDS (1)..(1365): transl_table=11

SEQ ID NO: 15908 - protein, 454 aa, Enterococcus faecalis; identical to SEQ ID NO: 8896

SEQ ID NO: 15909 - DNA, 1602 bp, Enterococcus faecalis; identical to SEQ ID NO: 8897
  CDS (1)..(1602): transl_table=11

SEQ ID NO: 15910 - protein, 533 aa, Enterococcus faecalis; identical to SEQ ID NO: 8898

SEQ ID NO: 15911 - DNA, 1533 bp, Lactococcus lactis subsp; identical to SEQ ID NO: 8899
  CDS (1)..(1533)

SEQ ID NO: 15912 - protein, 510 aa, Lactococcus lactis subsp; identical to SEQ ID NO: 8900

SEQ ID NO: 15913 - DNA, 1530 bp, Solanum lycopersicum; identical to SEQ ID NO: 8901
  CDS (1)..(1530)

SEQ ID NO: 15914 - protein, 509 aa, Solanum lycopersicum; identical to SEQ ID NO: 8902

SEQ ID NO: 15915 - DNA, 1593 bp, Solanum lycopersicum; identical to SEQ ID NO: 8903
  CDS (1)..(1593)

SEQ ID NO: 15916 - protein, 530 aa, Solanum lycopersicum; identical to SEQ ID NO: 8904

SEQ ID NO: 15917 - DNA, 1560 bp, Oryza sativa subsp; identical to SEQ ID NO: 8905
  CDS (1)..(1560)

SEQ ID NO: 15918 - protein, 519 aa, Oryza sativa subsp; identical to SEQ ID NO: 8906

SEQ ID NO: 15919 - DNA, 1936 bp, Chlamydomonas reinhardtii; identical to SEQ ID NO: 8907
  CDS (65)..(1606)

SEQ ID NO: 15920 - protein, 513 aa, Chlamydomonas reinhardtii; identical to SEQ ID NO: 8908

SEQ ID NO: 15921 - DNA, 1317 bp, Pseudomonas aeruginosa; identical to SEQ ID NO: 8909
  CDS (1)..(1317): transl_table=11

SEQ ID NO: 15922 - protein, 438 aa, Pseudomonas aeruginosa; identical to SEQ ID NO: 8910

SEQ ID NO: 15923 - DNA, 1386 bp, Agrobacterium tumefaciens; identical to SEQ ID NO: 8911
  CDS (1)..(1386): transl_table=11

SEQ ID NO: 15924 - protein, 461 aa, Agrobacterium tumefaciens; identical to SEQ ID NO: 8912

SEQ ID NO: 15925 - DNA, 1278 bp, Bacillus subtilis; identical to SEQ ID NO: 8913
  CDS (1)..(1278): transl_table=11

SEQ ID NO: 15926 - protein, 425 aa, Bacillus subtilis; identical to SEQ ID NO: 8914

SEQ ID NO: 15927 - DNA, 1353 bp, Bradyrhizobium japonicum; identical to SEQ ID NO: 8915
  CDS (1)..(1353): transl_table=11

SEQ ID NO: 15928 - protein, 450 aa, Bradyrhizobium japonicum; identical to SEQ ID NO: 8916

SEQ ID NO: 15929 - DNA, 1371 bp, Brucella melitensis; identical to SEQ ID NO: 8917
  CDS (1)..(1371): transl_table=11

SEQ ID NO: 15930 - protein, 456 aa, Brucella melitensis; identical to SEQ ID NO: 8918

SEQ ID NO: 15931 - DNA, 1296 bp, Clostridium acetobutylicum; identical to SEQ ID NO: 8919
  CDS (1)..(1296): transl_table=11

SEQ ID NO: 15932 - protein, 431 aa, Clostridium acetobutylicum; identical to SEQ ID NO: 8920

SEQ ID NO: 15933 - DNA, 1311 bp, Deinococcus radiodurans; identical to SEQ ID NO: 8921
  CDS (1)..(1311): transl_table=11

SEQ ID NO: 15934 - protein, 436 aa, Deinococcus radiodurans; identical to SEQ ID NO: 8922

SEQ ID NO: 15935 - DNA, 1667 bp, Lactobacillus brevis; identical to SEQ ID NO: 8923
  CDS (151)..(1545): transl_table=11

SEQ ID NO: 15936 - protein, 464 aa, Lactobacillus brevis; identical to SEQ ID NO: 8924

SEQ ID NO: 15937 - DNA, 1620 bp, Lactobacillus plantarum; identical to SEQ ID NO: 8925
  CDS (148)..(1542): transl_table=11

SEQ ID NO: 15938 - protein, 464 aa, Lactobacillus plantarum; identical to SEQ ID NO: 8926

SEQ ID NO: 15939 - DNA, 1347 bp, Listeria innocua; identical to SEQ ID NO: 8927
  CDS (1)..(1347): transl_table=11

SEQ ID NO: 15940 - protein, 448 aa, Listeria innocua; identical to SEQ ID NO: 8928

SEQ ID NO: 15941 - DNA, 1329 bp, Ralstonia solanacearum; identical to SEQ ID NO: 8929
  CDS (1)..(1329): transl_table=11

SEQ ID NO: 15942 - protein, 442 aa, Ralstonia solanacearum; identical to SEQ ID NO: 8930

SEQ ID NO: 15943 - DNA, 1365 bp, Rhizobium loti; identical to SEQ ID NO: 8931
  CDS (1)..(1365): transl_table=11

SEQ ID NO: 15944 - protein, 454 aa, Rhizobium loti; identical to SEQ ID NO: 8932

SEQ ID NO: 15945 - DNA, 2154 bp, Salmonella typhimurium; identical to SEQ ID NO: 8933
  CDS (451)..(1692): transl_table=11

SEQ ID NO: 15946 - protein, 413 aa, Salmonella typhimurium; identical to SEQ ID NO: 8934

SEQ ID NO: 15947 - DNA, 1353 bp, Staphylococcus aureus; identical to SEQ ID NO: 8935
  CDS (1)..(1353): transl_table=11

SEQ ID NO: 15948 - protein, 450 aa, Staphylococcus aureus; identical to SEQ ID NO: 8936

SEQ ID NO: 15949 - DNA, 1353 bp, Staphylococcus aureus; identical to SEQ ID NO: 8937
  CDS (1)..(1353): transl_table=11

SEQ ID NO: 15950 - protein, 450 aa, Staphylococcus aureus; identical to SEQ ID NO: 8938

SEQ ID NO: 15951 - DNA, 1362 bp, Staphylococcus epidermidis; identical to SEQ ID NO: 8939
  CDS (1)..(1362): transl_table=11

SEQ ID NO: 15952 - protein, 453 aa, Staphylococcus epidermidis; identical to SEQ ID NO: 8940

SEQ ID NO: 15953 - DNA, 1362 bp, Staphylococcus epidermidis; identical to SEQ ID NO: 8941
  CDS (1)..(1362): transl_table=11

SEQ ID NO: 15954 - protein, 453 aa, Staphylococcus epidermidis; identical to SEQ ID NO: 8942

SEQ ID NO: 15955 - DNA, 1230 bp, Yersinia pestis; identical to SEQ ID NO: 8943
  CDS (1)..(1230): transl_table=11

SEQ ID NO: 15956 - protein, 409 aa, Yersinia pestis; identical to SEQ ID NO: 8944

SEQ ID NO: 15957 - DNA, 1599 bp, Arabidopsis thaliana; identical to SEQ ID NO: 8945
  CDS (1)..(1599)

SEQ ID NO: 15958 - protein, 532 aa, Arabidopsis thaliana; identical to SEQ ID NO: 8946

SEQ ID NO: 15959 - DNA, 1593 bp, Arabidopsis thaliana; identical to SEQ ID NO: 8947
  CDS (1)..(1593)

SEQ ID NO: 15960 - protein, 530 aa, Arabidopsis thaliana; identical to SEQ ID NO: 8948

SEQ ID NO: 15961 - DNA, 1530 bp, Arabidopsis thaliana; identical to SEQ ID NO: 8949
  CDS (1)..(1530)

SEQ ID NO: 15962 - protein, 509 aa, Arabidopsis thaliana; identical to SEQ ID NO: 8950

SEQ ID NO: 15963 - DNA, 1593 bp, Arabidopsis thaliana; identical to SEQ ID NO: 8951
  CDS (1)..(1593)

SEQ ID NO: 15964 - protein, 530 aa, Arabidopsis thaliana; identical to SEQ ID NO: 8952

SEQ ID NO: 15965 - DNA, 1584 bp, Arabidopsis thaliana; identical to SEQ ID NO: 8953
  CDS (1)..(1584)

SEQ ID NO: 15966 - protein, 527 aa, Arabidopsis thaliana; identical to SEQ ID NO: 8954

SEQ ID NO: 15967 - DNA, 1566 bp, Schizosaccharomyces pombe; identical to SEQ ID NO: 8955
  CDS (1)..(1566)

SEQ ID NO: 15968 - protein, 521 aa, Schizosaccharomyces pombe; identical to SEQ ID NO: 8956

SEQ ID NO: 15969 - DNA, 2577 bp, Saccharomyces cerevisiae; identical to SEQ ID NO: 8957
  CDS (607)..(2334)

SEQ ID NO: 15970 - protein, 575 aa, Saccharomyces cerevisiae; identical to SEQ ID NO: 8958

SEQ ID NO: 15971 - DNA, 1650 bp, Saccharomyces cerevisiae; identical to SEQ ID NO: 8959
  CDS (1)..(1650)

SEQ ID NO: 15972 - protein, 549 aa, Saccharomyces cerevisiae; identical to SEQ ID NO: 8960

SEQ ID NO: 15973 - DNA, 1479 bp, Oryza sativa; identical to SEQ ID NO: 8961
  CDS (1)..(1479)

SEQ ID NO: 15974 - protein, 492 aa, Oryza sativa; identical to SEQ ID NO: 8962

SEQ ID NO: 15975 - DNA, 1422 bp, Saccharomyces cerevisiae; identical to SEQ ID NO: 8661
  CDS (1)..(1422)

SEQ ID NO: 15976 - protein, 473 aa, Saccharomyces cerevisiae; identical to SEQ ID NO: 8662

SEQ ID NO: 15977 - DNA, 1599 bp, Brassica napus; identical to SEQ ID NO: 8963
  CDS (1)..(1599)

SEQ ID NO: 15978 - protein, 532 aa, Brassica napus; identical to SEQ ID NO: 8964

SEQ ID NO: 15979 - DNA, 1602 bp, Brassica napus; identical to SEQ ID NO: 8965
  CDS (1)..(1602)

SEQ ID NO: 15980 - protein, 533 aa, Brassica napus; identical to SEQ ID NO: 8966

SEQ ID NO: 15981 - DNA, 1602 bp, Brassica napus; identical to SEQ ID NO: 8967
  CDS (1)..(1602)

SEQ ID NO: 15982 - protein, 533 aa, Brassica napus; identical to SEQ ID NO: 8968

SEQ ID NO: 15983 - DNA, 1611 bp, Glycine max; identical to SEQ ID NO: 8969
  CDS (1)..(1611)

SEQ ID NO: 15984 - protein, 536 aa, Glycine max; identical to SEQ ID NO: 8970

SEQ ID NO: 15985 - DNA, 1551 bp, Glycine max; identical to SEQ ID NO: 8971
  CDS (1)..(1551)

SEQ ID NO: 15986 - protein, 516 aa, Glycine max; identical to SEQ ID NO: 8972

SEQ ID NO: 15987 - DNA, 1569 bp, Glycine max; identical to SEQ ID NO: 8973
  CDS (1)..(1569)

SEQ ID NO: 15988 - protein, 522 aa, Glycine max; identical to SEQ ID NO: 8974

SEQ ID NO: 15989 - DNA, 1551 bp, Zea mays; identical to SEQ ID NO: 8975
  CDS (1)..(1551)

SEQ ID NO: 15990 - protein, 516 aa, Zea mays; identical to SEQ ID NO: 8976

SEQ ID NO: 15991 - DNA, 1629 bp, Zea mays; identical to SEQ ID NO: 8977
  CDS (1)..(1629)

SEQ ID NO: 15992 - protein, 542 aa, Zea mays; identical to SEQ ID NO: 8978

SEQ ID NO: 15993 - DNA, 1551 bp, Zea mays; identical to SEQ ID NO: 8979
  CDS (1)..(1551)

SEQ ID NO: 15994 - protein, 516 aa, Zea mays; identical to SEQ ID NO: 8980

SEQ ID NO: 15995 - DNA, 1653 bp, Zea mays; identical to SEQ ID NO: 8981
  CDS (1)..(1653)

SEQ ID NO: 15996 - protein, 550 aa, Zea mays; identical to SEQ ID NO: 8982

SEQ ID NO: 15997 - DNA, 25 bp, Artificial sequence
  primer
atgcgatcttatatgcagattcttc

SEQ ID NO: 15998 - DNA, 25 bp, Artificial sequence
  primer
ttaaaaatggatgtcggcacctaag

SEQ ID NO: 15999 - protein, 651 aa, Artificial sequence; identical to SEQ ID NO: 8985
  consensus sequence
  Variant (3)..(9): Xaa in position 3 to 9 is any amino acid
  Variant (11)..(11): Xaa in position 11 is any amino acid
  Variant (16)..(22): Xaa in position 16 to 22 is any amino acid
  Variant (23)..(23): Xaa in position 23 is any or no amino acid
  Variant (25)..(28): Xaa in position 25 to 28 is any amino acid
  Variant (30)..(30): Xaa in position 30 is any amino acid
  Variant (33)..(41): Xaa in position 33 to 41 is any amino acid
  Variant (43)..(45): Xaa in position 43 to 45 is any amino acid
  Variant (47)..(51): Xaa in position 47 to 51 is any amino acid
  Variant (54)..(55): Xaa in position 54 to 55 is any amino acid
  Variant (58)..(59): Xaa in position 58 to 59 is any amino acid
  Variant (61)..(76): Xaa in position 61 to 76 is any amino acid
  Variant (77)..(81): Xaa in position 77 to 81 is any or no amino acid
  Variant (83)..(85): Xaa in position 83 to 85 is any amino acid
  Variant (87)..(90): Xaa in position 87 to 90 is any amino acid
  Variant (92)..(92): Xaa in position 92 is any amino acid
  Variant (94)..(95): Xaa in position 94 to 95 is any amino acid
  Variant (97)..(98): Xaa in position 97 to 98 is any amino acid
  Variant (100)..(100): Xaa in position 100 is any amino acid
  Variant (102)..(106): Xaa in position 102 to 106 is any amino acid
  Variant (108)..(110): Xaa in position 108 to 110 is any amino acid
  Variant (111)..(112): Xaa in position 111 to 112 is any or no amino acid
  Variant (114)..(116): Xaa in position 114 to 116 is any amino acid
  Variant (118)..(120): Xaa in position 118 to 120 is any amino acid
  Variant (122)..(128): Xaa in position 122 to 128 is any amino acid
  Variant (130)..(134): Xaa in position 130 to 134 is any amino acid
  Variant (135)..(142): Xaa in position 135 to 142 is any or no amino acid
  Variant (144)..(145): Xaa in position 144 to 145 is any amino acid
  Variant (147)..(151): Xaa in position 147 to 151 is any amino acid
  Variant (153)..(159): Xaa in position 153 to 159 is any amino acid
  Variant (161)..(175): Xaa in position 161 to 175 is any amino acid
  Variant (176)..(182): Xaa in position 176 to 182 is any or no amino acid
  Variant (184)..(185): Xaa in position 184 to 185 is any amino acid
  Variant (186)..(186): Xaa in position 186 is any or no amino acid
  Variant (188)..(196): Xaa in position 188 to 196 is any amino acid
  Variant (197)..(207): Xaa in position 197 to 207 is any or no amino acid
  Variant (209)..(212): Xaa in position 209 to 212 is any amino acid
  Variant (215)..(216): Xaa in position 215 to 216 is any amino acid
  Variant (220)..(222): Xaa in position 220 to 222 is any amino acid
  Variant (226)..(230): Xaa in position 226 to 230 is any amino acid
  Variant (232)..(241): Xaa in position 232 to 241 is any amino acid
  Variant (242)..(326): Xaa in position 242 to 326 is any or no amino acid
  Variant (328)..(330): Xaa in position 328 to 330 is any amino acid
  Variant (332)..(341): Xaa in position 332 to 341 is any amino acid
  Variant (342)..(390): Xaa in position 342 to 390 is any or no amino acid
  Variant (392)..(394): Xaa in position 392 to 394 is any amino acid
  Variant (397)..(398): Xaa in position 397 to 398 is any amino acid
  Variant (400)..(401): Xaa in position 400 to 401 is any amino acid
  Variant (403)..(406): Xaa in position 403 to 406 is any amino acid
  Variant (408)..(409): Xaa in position 408 to 409 is any amino acid
  Variant (412)..(413): Xaa in position 412 to 413 is any amino acid
  Variant (415)..(415): Xaa in position 415 is any amino acid
  Variant (418)..(421): Xaa in position 418 to 421 is any amino acid
  Variant (422)..(426): Xaa in position 422 to 426 is any or no amino acid
  Variant (428)..(430): Xaa in position 428 to 430 is any amino acid
  Variant (432)..(433): Xaa in position 432 to 433 is any amino acid
  Variant (434)..(437): Xaa in position 434 to 437 is any or no amino acid
  Variant (439)..(457): Xaa in position 439 to 457 is any amino acid
  Variant (458)..(466): Xaa in position 458 to 466 is any or no amino acid
  Variant (468)..(468): Xaa in position 468 is any amino acid
  Variant (471)..(473): Xaa in position 471 to 473 is any amino acid
  Variant (475)..(478): Xaa in position 475 to 478 is any amino acid
  Variant (481)..(486): Xaa in position 481 to 486 is any amino acid
  Variant (487)..(489): Xaa in position 487 to 489 is any or no amino acid
  Variant (492)..(511): Xaa in position 492 to 511 is any amino acid
  Variant (512)..(650): Xaa in position 512 to 650 is any or no amino acid

SEQ ID NO: 16000 - protein, 15 aa, Artificial sequence
  protein pattern
  Variant (3)..(3): Xaa in position 3 is any amino acid
  Variant (4)..(4): Xaa in position 4 is Ile or Val
  Variant (8)..(8): Xaa in position 8 is any amino acid
  Variant (9)..(10): Xaa in position 9 to 10 is any or no amino acid
  Variant (12)..(12): Xaa in position 12 is any amino acid
  Variant (13)..(14): Xaa in position 13 to 14 is any or no amino acid
GAXXMPHXXXLXXXL

SEQ ID NO: 16001 - protein, 15 aa, Artificial sequence
  protein pattern
  Variant (3)..(3): Xaa in position 3 is Ala or Gly
  Variant (4)..(4): Xaa in position 4 is any amino acid
  Variant (5)..(5): Xaa in position 5 is Ile, Leu, Met or Val
  Variant (6)..(6): Xaa in position 6 is Ala, Ile or Val
  Variant (7)..(7): Xaa in position 7 is Ala or Ser
  Variant (8)..(8): Xaa in position 8 is Ile, Leu or Val
  Variant (9)..(9): Xaa in position 9 is Ala, Gly or Ser
  Variant (11)..(11): Xaa in position 11 is Ile, Leu, Met or Val
GPXXXXXXXYXDPGN

SEQ ID NO: 16002 - protein, 23 aa, Artificial sequence
  protein pattern
  Variant (2)..(2): Xaa in position 2 is any amino acid
  Variant (3)..(3): Xaa in position 3 is Ala, Cys, Ser or Thr
  Variant (4)..(4): Xaa in position 4 is Gly or Ser
  Variant (5)..(6): Xaa in position 5 to 6 is any amino acid
  Variant (7)..(7): Xaa in position 7 is Ala, Ser or Thr
  Variant (8)..(8): Xaa in position 8 is Ala, Gly, Ser or Thr
  Variant (9)..(10): Xaa in position 9 to 10 is any amino acid
  Variant (11)..(11): Xaa in position 11 is Ala, Cys, Gly, Ser or Thr
  Variant (13)..(13): Xaa in position 13 is any amino acid
  Variant (14)..(14): Xaa in position 14 is Ala, Ser or Thr
  Variant (16)..(16): Xaa in position 16 is Asp, Glu, Gln or Ser
  Variant (17)..(17): Xaa in position 17 is any amino acid
  Variant (18)..(18): Xaa in position 18 is Ile, Leu or Val
  Variant (19)..(20): Xaa in position 19 to 20 is any amino acid
  Variant (22)..(22): Xaa in position 22 is any amino acid
  Variant (23)..(23): Xaa in position 23 is Ile, Leu, Met or Val
LXXXXXXXXXXTXXGXXXXXGXX

SEQ ID NO: 16003 - protein, 22 aa, Artificial sequence
  protein pattern
  Variant (2)..(2): Xaa in position 2 is Ala, Ile, Leu or Val
  Variant (3)..(3): Xaa in position 3 is any amino acid
  Variant (4)..(4): Xaa in position 4 is Ala, Ile, Leu or Val
  Variant (5)..(5): Xaa in position 5 is any amino acid
  Variant (6)..(6): Xaa in position 6 is Ala or Gly
  Variant (7)..(7): Xaa in position 7 is Ala, Cys, Ser or Thr
  Variant (9)..(9): Xaa in position 9 is Ile, Leu or Val
  Variant (10)..(10): Xaa in position 10 is any amino acid
  Variant (12)..(12): Xaa in position 12 is Phe, Leu or Val
  Variant (13)..(13): Xaa in position 13 is Ile, Leu or Val
  Variant (15)..(15): Xaa in position 15 is Ala, Cys, Gly, Ser or Thr
  Variant (17)..(18): Xaa in position 17 to 18 is any amino acid
  Variant (19)..(21): Xaa in position 19 to 21 is any or no amino acid
EXXXXXXDXXEXXGXAXXXXXL

SEQ ID NO: 16004 - protein, 16 aa, Artificial sequence
  protein pattern
  Variant (2)..(2): Xaa in position 2 is any amino acid
  Variant (3)..(3): Xaa in position 3 is Leu or Met
  Variant (4)..(4): Xaa in position 4 is Ala, Cys or Ser
  Variant (5)..(6): Xaa in position 5 to 6 is any amino acid
  Variant (9)..(9): Xaa in position 9 is any amino acid
  Variant (10)..(10): Xaa in position 10 is Ala, Gly, Ile or Val
  Variant (11)..(14): Xaa in position 11 to 14 is any amino acid
  Variant (16)..(16): Xaa in position 16 is Ala, Pro or Ser
QXXXXXLGXXXXXXLX

SEQ ID NO: 16005 - DNA, 1788 bp, Saccharomyces cerevisiae
  CDS (1)..(1788)
atgcctaccgtctccgtgaacaagcagcaattatttgatcttctaggcaaaaactacacttcccaagagttcgatgaattatgttttgaattcggtatggaaatggacgaagacaccacagaggaggccttgaaaaccggggaggagccggaattgaagcttgatatcagtgccaatcgttacgatttgctttgtatcgaaggtatttcacagtcgctgaacgaatacttggaacgtaaagaaagacctgactataaattaagcaagccaaccactaagttgatcatcgacaaatcaacggagcaaattagaccttttgctaccgctgctgtattgagaaatatcaagcttaacgaaaaatcttacgcttcttttattgccttgcaagataaattacatgccaatctatgtagaaacagaagcttggttgccatgggtactcacgatttagattcaattgaaggtccattccattacagagctctaccaccaaaggacatcaagttcgtaccattgaatcaaacccaagagtttactggtgacaaattgatcgagttttataaatctccagaacagaaaaacaacatagggagatacgttcacattattgaggattctccagtcttcccagttattatggacagcaaagatcgtgtttgctccctgccaccattaatcaatagtgaacattcgaagatctctgtgaacacccgtaacattttgattgatataaccgccaccgataagaccaaagccgagatcgttttgaacatattaactacaatgttctcacgttattgtgacgaaccattcacggttgagcctgtagaaattgtctctgaacacaatggccaatcccgtttggcgccaaacttcaacgatagaattatggatgtctccattaagtacatcaactcctgtcttggcctagatcaatccgctgatgaaattgctcattgtctaaagaagatgtcgttgcatgccgttcaatcaaaggaagacaaggacatcttgcacgttgacattccggtaactagacctgatattttgcacgcttgtgatataatggaagatgccgctgtcggttatggtttcaataatttgccaaagggtgagaaattatccaatgccaacttcattgccaaaccattaccaatcaacaaggtttctgatattttcagagttgcatcctctcaagccacgtgggttgaggttttaccattgaccttatgttcgcacgatgaaaactttaaatttctaagacaatccgacaatggtgatttagctgtcaaattggccaacccaaagactttggaataccaagttgttagaaccactttattgcctggtatcttaaagacagtcaaggaaaacagaaaacattccttgccaatcaaagtctttgaaaccggtgacgttgtatttaaagacgacaaactagaaaggaaggcgtacaatgaacgtcactgggctgccatctacgtgggtaagaattctgggtttgaaatcattcaagggttattgggtaaaatcatgcaaacttttagaacagagtggattgcagactacggtgctgctgcttctggcagaggttactggattgaagaagacgattctgtgaaaacctacttcccaggtagaggtgccaaggtcatgttcagatccaaagaaggcgctgagccaaagcaaatcggccacttgggtgtcttgcatcctgaagtcatgatgaatttcgacgctccattcgctgcatcctttgtagaggttaatgccgaagtcttcctataa

SEQ ID NO: 16006 - protein, 595 aa, Saccharomyces cerevisiae
MPTVSVNKQQLFDLLGKNYTSQEFDELCFEFGMEMDEDTTEEALKTGEEPELKLDISANRYDLLCIEGISQSLNEYLERKERPDYKLSKPTTKLIIDKSTEQIRPFATAAVLRNIKLNEKSYASFIALQDKLHANLCRNRSLVAMGTHDLDSIEGPFHYRALPPKDIKFVPLNQTQEFTGDKLIEFYKSPEQKNNIGRYVHIIEDSPVFPVIMDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNGDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYFPGRGAKVMFRSKEGAEPKQIGHLGVLHPEVMMNFDAPFAASFVEVNAEVFL

SEQ ID NO: 16007 - DNA, 1779 bp, Candida albicans; identical to SEQ ID NO: 9553
  CDS (1)..(1779): transl_table=12

SEQ ID NO: 16008 - protein, 592 aa, Candida albicans; identical to SEQ ID NO: 9554

SEQ ID NO: 16009 - DNA, 1791 bp, Oryza sativa (japonica cultivar-group); identical to SEQ ID NO: 9555
  CDS (1)..(1791)

SEQ ID NO: 16010 - protein, 596 aa, Oryza sativa (japonica cultivar-group); identical to SEQ ID NO: 9556

SEQ ID NO: 16011 - DNA, 1674 bp, Encephalitozoon cuniculi GB-M1; identical to SEQ ID NO: 9557
  CDS (1)..(1674)

SEQ ID NO: 16012 - protein, 557 aa, Encephalitozoon cuniculi GB-M1; identical to SEQ ID NO: 9558

SEQ ID NO: 16013 - DNA, 1755 bp, Arabidopsis thaliana; identical to SEQ ID NO: 9559
  CDS (1)..(1755)

SEQ ID NO: 16014 - protein, 584 aa, Arabidopsis thaliana; identical to SEQ ID NO: 9560

SEQ ID NO: 16015 - DNA, 1665 bp, Methanococcus maripaludis S2; identical to SEQ ID NO: 9561
  CDS (1)..(1665): transl_table=11

SEQ ID NO: 16016 - protein, 554 aa, Methanococcus maripaludis S2; identical to SEQ ID NO: 9562

SEQ ID NO: 16017 - DNA, 1830 bp, Gibberella zeae PH-1; identical to SEQ ID NO: 9563
  CDS (1)..(1830)

SEQ ID NO: 16018 - protein, 609 aa, Gibberella zeae PH-1; identical to SEQ ID NO: 9564

SEQ ID NO: 16019 - DNA, 1788 bp, Candida glabrata CBS 138; identical to SEQ ID NO: 9565
  CDS (1)..(1788)

SEQ ID NO: 16020 - protein, 595 aa, Candida glabrata CBS 138; identical to SEQ ID NO: 9566

SEQ ID NO: 16021 - DNA, 1788 bp, Kluyveromyces lactis NRRL Y-1140; identical to SEQ ID NO: 9567
  CDS (1)..(1788)

SEQ ID NO: 16022 - protein, 595 aa, Kluyveromyces lactis NRRL Y-1140; identical to SEQ ID NO: 9568

SEQ ID NO: 16023 - DNA, 1773 bp, Debaryomyces hansenii CBS767; identical to SEQ ID NO: 9569
  CDS (1)..(1773)

SEQ ID NO: 16024 - protein, 590 aa, Debaryomyces hansenii CBS767; identical to SEQ ID NO: 9570

SEQ ID NO: 16025 - DNA, 1782 bp, Yarrowia lipolytica CLIB122; identical to SEQ ID NO: 9571
  CDS (1)..(1782)

SEQ ID NO: 16026 - protein, 593 aa, Yarrowia lipolytica CLIB122; identical to SEQ ID NO: 9572

SEQ ID NO: 16027 - DNA, 1779 bp, Candida albicans SC5314; identical to SEQ ID NO: 9573
  CDS (1)..(1779): transl_table=12

SEQ ID NO: 16028 - protein, 592 aa, Candida albicans SC5314; identical to SEQ ID NO: 9574

SEQ ID NO: 16029 - DNA, 1866 bp, Ustilago maydis 521; identical to SEQ ID NO: 9575
  CDS (1)..(1866)

SEQ ID NO: 16030 - protein, 621 aa, Ustilago maydis 521; identical to SEQ ID NO: 9576

SEQ ID NO: 16031 - DNA, 1899 bp, Cryptococcus neoformans var. neoformans B-3501A; identical to SEQ ID NO: 9577
  CDS (1)..(1899)

SEQ ID NO: 16032 - protein, 632 aa, Cryptococcus neoformans var. neoformans B-3501A; identical to SEQ ID NO: 9578

SEQ ID NO: 16033 - DNA, 1701 bp, Borrelia garinii PBi; identical to SEQ ID NO: 9579
  CDS (1)..(1701): transl_table=11

SEQ ID NO: 16034 - protein, 566 aa, Borrelia garinii PBi; identical to SEQ ID NO: 9580

SEQ ID NO: 16035 - DNA, 1635 bp, Methanosarcina barkeri str. Fusaro; identical to SEQ ID NO: 9581
  CDS (1)..(1635): transl_table=11

SEQ ID NO: 16036 - protein, 544 aa, Methanosarcina barkeri str. Fusaro; identical to SEQ ID NO: 9582

SEQ ID NO: 16037 - DNA, 1623 bp, Methanococcoides burtonii DSM 6242; identical to SEQ ID NO: 9583
  CDS (1)..(1623): transl_table=11

SEQ ID NO: 16038 - protein, 540 aa, Methanococcoides burtonii DSM 6242; identical to SEQ ID NO: 9584

SEQ ID NO: 16039 - DNA, 1782 bp, Phaeosphaeria nodorum; identical to SEQ ID NO: 9585
  CDS (1)..(1782)

SEQ ID NO: 16040 - protein, 593 aa, Phaeosphaeria nodorum; identical to SEQ ID NO: 9586

SEQ ID NO: 16041 - DNA, 1806 bp, Medicago truncatula; identical to SEQ ID NO: 9587
  CDS (1)..(1806)

SEQ ID NO: 16042 - protein, 601 aa, Medicago truncatula; identical to SEQ ID NO: 9588

SEQ ID NO: 16043 - DNA, 1890 bp, Haloquadratum walsbyi; identical to SEQ ID NO: 9589
  CDS (1)..(1890): transl_table=11

SEQ ID NO: 16044 - protein, 629 aa, Haloquadratum walsbyi; identical to SEQ ID NO: 9590

SEQ ID NO: 16045 - DNA, 1770 bp, Aspergillus oryzae; identical to SEQ ID NO: 9591
  CDS (1)..(1770)

SEQ ID NO: 16046 - protein, 589 aa, Aspergillus oryzae; identical to SEQ ID NO: 9592

SEQ ID NO: 16047 - DNA, 1788 bp, Saccharomyces cerevisiae; identical to SEQ ID NO: 9593
  CDS (1)..(1788)

SEQ ID NO: 16048 - protein, 595 aa, Saccharomyces cerevisiae; identical to SEQ ID NO: 9594

SEQ ID NO: 16049 - DNA, 1965 bp, Arabidopsis thaliana; identical to SEQ ID NO: 9595
  CDS (1)..(1797)

SEQ ID NO: 16050 - protein, 598 aa, Arabidopsis thaliana; identical to SEQ ID NO: 9596

SEQ ID NO: 16051 - DNA, 1644 bp, Archaeoglobus fulgidus; identical to SEQ ID NO: 9597
  CDS (1)..(1644): transl_table=11

SEQ ID NO: 16052 - protein, 547 aa, Archaeoglobus fulgidus; identical to SEQ ID NO: 9598

SEQ ID NO: 16053 - DNA, 1701 bp, Borrelia burgdorferi; identical to SEQ ID NO: 9599
  CDS (1)..(1701): transl_table=11

SEQ ID NO: 16054 - protein, 566 aa, Borrelia burgdorferi; identical to SEQ ID NO: 9600

SEQ ID NO: 16055 - DNA, 1779 bp, Candida albicans; identical to SEQ ID NO: 9601
  CDS (1)..(1779): transl_table=12

SEQ ID NO: 16056 - protein, 592 aa, Candida albicans; identical to SEQ ID NO: 9602

SEQ ID NO: 16057 - DNA, 1755 bp, Haloarcula marismortui; identical to SEQ ID NO: 9603
  CDS (1)..(1755): transl_table=11

SEQ ID NO: 16058 - protein, 584 aa, Haloarcula marismortui; identical to SEQ ID NO: 9604

SEQ ID NO: 16059 - DNA, 1704 bp, Halobacterium salinarium; identical to SEQ ID NO: 9605
  CDS (1)..(1704): transl_table=11

SEQ ID NO: 16060 - protein, 567 aa, Halobacterium salinarium; identical to SEQ ID NO: 9606

SEQ ID NO: 16061 - DNA, 1647 bp, Methanococcus jannaschii; identical to SEQ ID NO: 9607
  CDS (1)..(1647): transl_table=11

SEQ ID NO: 16062 - protein, 548 aa, Methanococcus jannaschii; identical to SEQ ID NO: 9608

SEQ ID NO: 16063 - DNA, 1638 bp, Methanosarcina mazei; identical to SEQ ID NO: 9609
  CDS (1)..(1638): transl_table=11

SEQ ID NO: 16064 - protein, 545 aa, Methanosarcina mazei; identical to SEQ ID NO: 9610

SEQ ID NO: 16065 - DNA, 1650 bp, Methanobacterium thermoautotrophicum; identical to SEQ ID NO: 9611
  CDS (1)..(1650): transl_table=11

SEQ ID NO: 16066 - protein, 549 aa, Methanobacterium thermoautotrophicum; identical to SEQ ID NO: 9612

SEQ ID NO: 16067 - DNA, 1671 bp, Pyrococcus abyssi; identical to SEQ ID NO: 9613
  CDS (1)..(1671): transl_table=11

SEQ ID NO: 16068 - protein, 556 aa, Pyrococcus abyssi; identical to SEQ ID NO: 9614

SEQ ID NO: 16069 - DNA, 1671 bp, Pyrococcus furiosus; identical to SEQ ID NO: 9615
  CDS (1)..(1671): transl_table=11

SEQ ID NO: 16070 - protein, 556 aa, Pyrococcus furiosus; identical to SEQ ID NO: 9616

SEQ ID NO: 16071 - DNA, 1671 bp, Pyrococcus horikoshii; identical to SEQ ID NO: 9617
  CDS (1)..(1671): transl_table=11

SEQ ID NO: 16072 - protein, 556 aa, Pyrococcus horikoshii; identical to SEQ ID NO: 9618

SEQ ID NO: 16073 - DNA, 1725 bp, Pyrococcus kodakaraensis; identical to SEQ ID NO: 9619
  CDS (1)..(1725): transl_table=11

SEQ ID NO: 16074 - protein, 574 aa, Pyrococcus kodakaraensis; identical to SEQ ID NO: 9620

SEQ ID NO: 16075 - DNA, 1770 bp, Schizosaccharomyces pombe; identical to SEQ ID NO: 9621
  CDS (1)..(1770)

SEQ ID NO: 16076 - protein, 589 aa, Schizosaccharomyces pombe; identical to SEQ ID NO: 9622

SEQ ID NO: 16077 - DNA, 1629 bp, Sulfolobus acidocaldarius; identical to SEQ ID NO: 9623
  CDS (1)..(1629): transl_table=11

SEQ ID NO: 16078 - protein, 542 aa, Sulfolobus acidocaldarius; identical to SEQ ID NO: 9624

SEQ ID NO: 16079 - DNA, 1635 bp, Sulfolobus solfataricus; identical to SEQ ID NO: 9625
  CDS (1)..(1635): transl_table=11

SEQ ID NO: 16080 - protein, 544 aa, Sulfolobus solfataricus; identical to SEQ ID NO: 9626

SEQ ID NO: 16081 - DNA, 1623 bp, Sulfolobus tokodaii; identical to SEQ ID NO: 9627
  CDS (1)..(1623): transl_table=11

SEQ ID NO: 16082 - protein, 540 aa, Sulfolobus tokodaii; identical to SEQ ID NO: 9628

SEQ ID NO: 16083 - DNA, 1788 bp, Saccharomyces cerevisiae; identical to SEQ ID NO: 9551
  CDS (1)..(1788)

SEQ ID NO: 16084 - protein, 595 aa, Saccharomyces cerevisiae; identical to SEQ ID NO: 9552

SEQ ID NO: 16085 - DNA, 23 bp, Artificial sequence
  primer
atgcctaccgtctccgtgaacaa

SEQ ID NO: 16086 - DNA, 25 bp, Artificial sequence
  primer
ttataggaagacttcggcattaacc

SEQ ID NO: 16087 - protein, 745 aa, Artificial sequence; identical to SEQ ID NO: 9631
  consensus sequence
  Variant (3)..(10): Xaa in position 3 to 10 is any amino acid
  Variant (12)..(31): Xaa in position 12 to 31 is any amino acid
  Variant (32)..(34): Xaa in position 32 to 34 is any or no amino acid
  Variant (36)..(51): Xaa in position 36 to 51 is any amino acid
  Variant (52)..(75): Xaa in position 52 to 75 is any or no amino acid
  Variant (77)..(77): Xaa in position 77 is any amino acid
  Variant (79)..(82): Xaa in position 79 to 82 is any amino acid
  Variant (85)..(85): Xaa in position 85 is any amino acid
  Variant (87)..(117): Xaa in position 87 to 117 is any amino acid
  Variant (118)..(125): Xaa in position 118 to 125 is any or no amino acid
  Variant (128)..(131): Xaa in position 128 to 131 is any amino acid
  Variant (133)..(144): Xaa in position 133 to 144 is any amino acid
  Variant (145)..(148): Xaa in position 145 to 148 is any or no amino acid
  Variant (150)..(151): Xaa in position 150 to 151 is any amino acid
  Variant (153)..(153): Xaa in position 153 is any amino acid
  Variant (157)..(160): Xaa in position 157 to 160 is any amino acid
  Variant (162)..(162): Xaa in position 162 is any amino acid
  Variant (164)..(165): Xaa in position 164 to 165 is any amino acid
  Variant (170)..(170): Xaa in position 170 is any amino acid
  Variant (173)..(180): Xaa in position 173 to 180 is any amino acid
  Variant (181)..(222): Xaa in position 181 to 222 is any or no amino acid
  Variant (224)..(231): Xaa in position 224 to 231 is any amino acid
  Variant (232)..(234): Xaa in position 232 to 234 is any or no amino acid
  Variant (236)..(236): Xaa in position 236 is any amino acid
  Variant (239)..(250): Xaa in position 239 to 250 is any amino acid
  Variant (251)..(251): Xaa in position 251 is any or no amino acid
  Variant (253)..(269): Xaa in position 253 to 269 is any amino acid
  Variant (270)..(276): Xaa in position 270 to 276 is any or no amino acid
  Variant (278)..(280): Xaa in position 278 to 280 is any amino acid
  Variant (281)..(281): Xaa in position 281 is any or no amino acid
  Variant (283)..(285): Xaa in position 283 to 285 is any amino acid
  Variant (286)..(286): Xaa in position 286 is any or no amino acid
  Variant (288)..(288): Xaa in position 288 is any amino acid
  Variant (290)..(290): Xaa in position 290 is any amino acid
  Variant (293)..(293): Xaa in position 293 is any amino acid
  Variant (296)..(304): Xaa in position 296 to 304 is any amino acid
  Variant (305)..(305): Xaa in position 305 is any or no amino acid
  Variant (307)..(310): Xaa in position 307 to 310 is any amino acid
  Variant (312)..(313): Xaa in position 312 to 313 is any amino acid
  Variant (315)..(349): Xaa in position 315 to 349 is any amino acid
  Variant (350)..(361): Xaa in position 350 to 361 is any or no amino acid
  Variant (363)..(380): Xaa in position 363 to 380 is any amino acid
  Variant (382)..(392): Xaa in position 382 to 392 is any amino acid
  Variant (394)..(411): Xaa in position 394 to 411 is any amino acid
  Variant (412)..(429): Xaa in position 412 to 429 is any or no amino acid
  Variant (431)..(432): Xaa in position 431 to 432 is any amino acid
  Variant (434)..(434): Xaa in position 434 is any amino acid
  Variant (436)..(437): Xaa in position 436 to 437 is any amino acid
  Variant (439)..(440): Xaa in position 439 to 440 is any amino acid
  Variant (442)..(443): Xaa in position 442 to 443 is any amino acid
  Variant (446)..(450): Xaa in position 446 to 450 is any amino acid
  Variant (452)..(475): Xaa in position 452 to 475 is any amino acid
  Variant (476)..(485): Xaa in position 476 to 485 is any or no amino acid
  Variant (487)..(492): Xaa in position 487 to 492 is any amino acid
  Variant (494)..(495): Xaa in position 494 to 495 is any amino acid
  Variant (497)..(501): Xaa in position 497 to 501 is any amino acid
  Variant (503)..(517): Xaa in position 503 to 517 is any amino acid
  Variant (518)..(541): Xaa in position 518 to 541 is any or no amino acid
  Variant (543)..(550): Xaa in position 543 to 550 is any amino acid
  Variant (552)..(555): Xaa in position 552 to 555 is any amino acid
  Variant (557)..(564): Xaa in position 557 to 564 is any amino acid
  Variant (566)..(570): Xaa in position 566 to 570 is any amino acid
  Variant (572)..(574): Xaa in position 572 to 574 is any amino acid
  Variant (577)..(590): Xaa in position 577 to 590 is any amino acid
  Variant (591)..(600): Xaa in position 591 to 600 is any or no amino acid
  Variant (602)..(610): Xaa in position 602 to 610 is any amino acid
  Variant (612)..(641): Xaa in position 612 to 641 is any amino acid
  Variant (642)..(667): Xaa in position 642 to 667 is any or no amino acid
  Variant (670)..(670): Xaa in position 670 is any amino acid
  Variant (672)..(680): Xaa in position 672 to 680 is any amino acid
  Variant (681)..(721): Xaa in position 681 to 721 is any or no amino acid
  Variant (723)..(724): Xaa in position 723 to 724 is any amino acid
  Variant (726)..(728): Xaa in position 726 to 728 is any amino acid
  Variant (730)..(730): Xaa in position 730 is any amino acid
  Variant (732)..(744): Xaa in position 732 to 744 is any amino acid

SEQ ID NO: 16088 - protein, 29 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is Asp or Glu
  Variant (8)..(8): Xaa in position 8 is Leu or Val
  Variant (9)..(10): Xaa in position 9 to 10 is any amino acid
  Variant (11)..(11): Xaa in position 11 is Ala, Asn, Ser, Thr or Val
  Variant (12)..(12): Xaa in position 12 is any amino acid
  Variant (13)..(13): Xaa in position 13 is Ala, Cys or Gly
  Variant (14)..(14): Xaa in position 14 is Gln or Arg
  Variant (15)..(15): Xaa in position 15 is any amino acid
  Variant (17)..(18): Xaa in position 17 to 18 is any amino acid
  Variant (19)..(19): Xaa in position 19 is Gly, Ile, Leu or Val
  Variant (20)..(20): Xaa in position 20 is Ala or Ser
  Variant (21)..(21): Xaa in position 21 is Ile or Met
  Variant (23)..(23): Xaa in position 23 is any amino acid
  Variant (24)..(24): Xaa in position 24 is Phe, His or Tyr
  Variant (25)..(25): Xaa in position 25 is Asp or Asn
  Variant (26)..(28): Xaa in position 26 to 28 is any amino acid
  Variant (29)..(29): Xaa in position 29 is Ile, Leu, Met or Val
IXXXQXKXXXXXXXXRXXXXXGXXXXXXX

SEQ ID NO: 16089 - protein, 41 aa, Artificial sequence; identical to SEQ ID NO: 9633
  protein pattern
  Variant (2)..(2): Xaa in position 2 is any amino acid
  Variant (3)..(3): Xaa in position 3 is Ser or Thr
  Variant (4)..(9): Xaa in position 4 to 9 is any amino acid
  Variant (11)..(12): Xaa in position 11 to 12 is any amino acid
  Variant (13)..(13): Xaa in position 13 is Ile, Leu or Val
  Variant (14)..(14): Xaa in position 14 is Ile, Leu, Met or Val
  Variant (16)..(16): Xaa in position 16 is any amino acid
  Variant (17)..(17): Xaa in position 17 is any or no amino acid
  Variant (19)..(23): Xaa in position 19 to 23 is any amino acid
  Variant (24)..(24): Xaa in position 24 is any or no amino acid
  Variant (26)..(30): Xaa in position 26 to 30 is any amino acid
  Variant (32)..(34): Xaa in position 32 to 34 is any amino acid
  Variant (37)..(37): Xaa in position 37 is any amino acid
  Variant (38)..(38): Xaa in position 38 is Gly or Ser
  Variant (39)..(40): Xaa in position 39 to 40 is any amino acid
  Variant (41)..(41): Xaa in position 41 is Ala, Gly, Thr or Val

SEQ ID NO: 16090 - protein, 28 aa, Artificial sequence
  protein pattern
  Variant (2)..(3): Xaa in position 2 to 3 is any amino acid
  Variant (5)..(5): Xaa in position 5 is any amino acid
  Variant (7)..(7): Xaa in position 7 is Ile or Val
  Variant (8)..(8): Xaa in position 8 is Phe, Ile, Leu or Met
  Variant (9)..(11): Xaa in position 9 to 11 is any amino acid
  Variant (13)..(13): Xaa in position 13 is Ile, Leu or Val
  Variant (14)..(14): Xaa in position 14 is any amino acid
  Variant (16)..(17): Xaa in position 16 to 17 is any amino acid
  Variant (18)..(19): Xaa in position 18 to 19 is any or no amino acid
  Variant (21)..(21): Xaa in position 21 is any amino acid
  Variant (22)..(23): Xaa in position 22 to 23 is any or no amino acid
  Variant (25)..(25): Xaa in position 25 is Phe or Tyr
  Variant (26)..(26): Xaa in position 26 is Asp, Glu, Gly or Asn
  Variant (27)..(27): Xaa in position 27 is any amino acid
  Variant (28)..(28): Xaa in position 28 is Phe, Ile, Leu or Val
PXXRXDXXXXXDXXEXXXXAXXXGXXXX

SEQ ID NO: 16091 - protein, 16 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (9)..(9): Xaa in position 9 is any amino acid
  Variant (12)..(12): Xaa in position 12 is any or no amino acid
  Variant (14)..(14): Xaa in position 14 is any or no amino acid
  Variant (16)..(16): Xaa in position 16 is Ala, Gly or Ser
DXXXXVXSXPPXIXNX

SEQ ID NO: 16092 - protein, 25 aa, Artificial sequence
  protein pattern
  Variant (2)..(2): Xaa in position 2 is any amino acid
  Variant (3)..(3): Xaa in position 3 is Phe, Ile or Leu
  Variant (5)..(9): Xaa in position 5 to 9 is any or no amino acid
  Variant (11)..(11): Xaa in position 11 is Ile, Leu or Met
  Variant (12)..(13): Xaa in position 12 to 13 is any amino acid
  Variant (14)..(14): Xaa in position 14 is Phe, His, Trp or Tyr
  Variant (15)..(15): Xaa in position 15 is Ala, Asp, Glu, Gly, Asn or Ser
  Variant (16)..(16): Xaa in position 16 is Ile, Leu or Val
  Variant (17)..(18): Xaa in position 17 to 18 is any amino acid
  Variant (19)..(19): Xaa in position 19 is Ala or Pro
  Variant (20)..(20): Xaa in position 20 is Ala, Cys, Gly, Thr or Val
  Variant (21)..(21): Xaa in position 21 is Ala, Ser, Thr or Val
  Variant (22)..(23): Xaa in position 22 to 23 is any amino acid
  Variant (25)..(25): Xaa in position 25 is Phe, Ile, Leu or Val
GXXGXXXXXVXXXXXXXXXXXXXEX

SEQ ID NO: 16093 - DNA, 354 bp, SACCHAROMYCES CEREVISIAE
  CDS (1)..(354)
atggatggatcgactatagtgtttatactgacgatggtgtgcttgtttgtttacaccgtgaaacacaggggcgccaagcaagtaccctcgcgaaccgtacaggatgccaaaccggcgccctcggtcgccaccaacgacccttctccggagccagtaccatcggctccggaggaacgcgttgctcggttaaacagacatggtagtgatcgaaagagagccgttaatagtgacatggttgaaatcgtgatgacgatggcgccacatgtgcctcaggaaaaagtcgtgcaagatctcaggaacacagggtccattgagcacacaatggaaaatatcttcgctggcaaactagattag

SEQ ID NO: 16094 - protein, 117 aa, SACCHAROMYCES CEREVISIAE
MDGSTIVFILTMVCLFVYTVKHRGAKQVPSRTVQDAKPAPSVATNDPSPEPVPSAPEERVARLNRHGSDRKRAVNSDMVEIVMTMAPHVPQEKVVQDLRNTGSIEHTMENIFAGKLD

SEQ ID NO: 16095 - DNA, 555 bp, Ashbya gossypii
  CDS (1)..(555)
atggatcaatcctctgcactcttcctagctttgctgctggtgctgttcgttttggtgaagtggtttattaaaaccgagtcccacccctcagcgcagcacgccacggtagacacgggactctcgtcgcagagcactggcgctgcaggcgggcgcgcgcaaggcacaggtgcggtgcgcaggcgccggcgtccggtgaatgatgacatgattgaagtcgttcaggcgctggccccccacttgcactccgaacagatacgctacgacttggaacgatccgggtcggtggaggcgacggtggagcggtacctgcggggggaagactttcctttcccgccgggatatacagctcccatcccgccagagagccctcagcaggacagcagcgaccctcgcaagcgaagcaacatacgtgctgatgacctactgcaaaagtatgatgtggatcctgcagaggacatgtctgcagtggagtttcatgagctagatatggatgcgcggaagcgttttatggtatggcgcgctcgtaagcggatggaggcaaatctgcagaaatga

SEQ ID NO: 16096 - protein, 184 aa, Ashbya gossypii
MDQSSALFLALLLVLFVLVKWFIKTESHPSAQHATVDTGLSSQSTGAAGGRAQGTGAVRRRRRPVNDDMIEVVQALAPHLHSEQIRYDLERSGSVEATVERYLRGEDFPFPPGYTAPIPPESPQQDSSDPRKRSNIRADDLLQKYDVDPAEDMSAVEFHELDMDARKRFMVWRARKRMEANLQK

SEQ ID NO: 16097 - DNA, 612 bp, Candida glabrata
  CDS (1)..(612)
atggagcacagtgcagcagtggtagtggctactttaatactcggaatatttgttgttaaatggtttgcagccccgaaggaacatccatccgcacaaaggttacctaatacgcagcttccttcttcatccaataatcaacagagaactgctggtagctcaaatggcagaggctcacagcgtcgtgtttcttcgactagtagaagaaacattacacctgaaatgatagagacagtccgcaatgttattccagctctgcatcctgaacaaatcagatatgatttggaaagtactgggtccgtagaacaaacaatggaaagatactttaatggtgaatctttccctttccctcctggttacacacctgctagagaaagctcagcgaatgggcaacataataatatagacgagcctagtgacattcgcaaaagaagtaacataagacctgataatcttttatcgaaattcaacgttgatatgtccgtagatatgtctgatatgagcattaaagaattagaaattgatgaaaggaagaaattacttgtatgggaagcaagaaaaaatatggagaaacgacttgaaactgatacagaactagcatcacttataaagtaa

SEQ ID NO: 16098 - protein, 203 aa, Candida glabrata
MEHSAAVVVATLILGIFVVKWFAAPKEHPSAQRLPNTQLPSSSNNQQRTAGSSNGRGSQRRVSSTSRRNITPEMIETVRNVIPALHPEQIRYDLESTGSVEQTMERYFNGESFPFPPGYTPARESSANGQHNNIDEPSDIRKRSNIRPDNLLSKFNVDMSVDMSDMSIKELEIDERKKLLVWEARKNMEKRLETDTELASLIK

SEQ ID NO: 16099 - DNA, 621 bp, Debaryomyces hansenii
  CDS (1)..(621)
atggataattcaacgattgtatttattgctgtcctaggcgtcgcattcatctttttaagatggttgattgctccgatcccaccgcaattacctaatgaattaaatgaggcccttgcaaattcggttaataattccaatagacctaataatagtaataattccaactctgctaccaatagtaatgctaataggagaggaagaagagaaccttctgatgacatgattgaggtggttcaaactatagctcctcaattaacaaggggccaaattagaatggatttagaaagatctggttccgtcgaggtaactatggaaagatacatggagacaggcagtttaccattcccacctggagaatctgccgctacccagagctaccagtcagatataagtgaacattcgcaagcgacaaagaaagaacctgaaaatttgattgacaagtatgacttgaagtcaaaaattaagggcgacgaaggtgaaggaatagaaaacattgatgagaataaatggggttcaagcaaggaggaaagatcatcattgttaaacaaaaagagagaagaaatgattttacaagccagaaagagattagcttctcaattacaaaatgaggtcgcgttataa

SEQ ID NO: 16100 - protein, 206 aa, Debaryomyces hansenii
MDNSTIVFIAVLGVAFIFLRWLIAPIPPQLPNELNEALANSVNNSNRPNNSNNSNSATNSNANRRGRREPSDDMIEVVQTIAPQLTRGQIRMDLERSGSVEVTMERYMETGSLPFPPGESAATQSYQSDISEHSQATKKEPENLIDKYDLKSKIKGDEGEGIENIDENKWGSSKEERSSLLNKKREEMILQARKRLASQLQNEVAL

SEQ ID NO: 16101 - DNA, 25 bp, Artificial sequence
  primer
atggatggatcgactatagtgttta

SEQ ID NO: 16102 - DNA, 25 bp, Artificial sequence
  primer
ctaatctagtttgccagcgaagata

SEQ ID NO: 16103 - protein, 109 aa, Artificial sequence
  consensus sequence
  Variant (2)..(3): Xaa in position 2 to 3 is any amino acid
  Variant (5)..(62): Xaa in position 5 to 62 is any amino acid
  Variant (63)..(71): Xaa in position 63 to 71 is any or no amino acid
  Variant (73)..(77): Xaa in position 73 to 77 is any amino acid
  Variant (79)..(79): Xaa in position 79 is any amino acid
  Variant (81)..(81): Xaa in position 81 is any amino acid
  Variant (83)..(86): Xaa in position 83 to 86 is any amino acid
  Variant (88)..(96): Xaa in position 88 to 96 is any amino acid
  Variant (99)..(101): Xaa in position 99 to 101 is any amino acid
  Variant (104)..(104): Xaa in position 104 is any amino acid
  Variant (106)..(106): Xaa in position 106 is any amino acid
  Variant (108)..(108): Xaa in position 108 is any amino acid
MXXSXXXXXXXXXXXXXXXXXXXXXXXXXXXXXXXXXXXXXXXXXXXXXXXXXXXXXXXXXXXXXXXXXXXRXXXXXMXEXVXXXXPXXXXXXXXXDLXXXGSXEXTXE

SEQ ID NO: 16104 - protein, 45 aa, Artificial sequence
  protein pattern
  Variant (2)..(2): Xaa in position 2 is any amino acid
  Variant (3)..(3): Xaa in position 3 is Ile, Pro or Val
  Variant (4)..(4): Xaa in position 4 is Asn, Ser or Thr
  Variant (5)..(5): Xaa in position 5 is Asp, Pro or Ser
  Variant (6)..(6): Xaa in position 6 is Asp or Glu
  Variant (8)..(9): Xaa in position 8 to 9 is any or no amino acid
  Variant (11)..(12): Xaa in position 11 to 12 is any or no amino acid
  Variant (14)..(14): Xaa in position 14 is any amino acid
  Variant (15)..(15): Xaa in position 15 is Ala, Asn, Gln or Thr
  Variant (16)..(16): Xaa in position 16 is Ile, Leu, Met or Val
  Variant (17)..(17): Xaa in position 17 is Ala or Ile
  Variant (19)..(19): Xaa in position 19 is any amino acid
  Variant (20)..(20): Xaa in position 20 is Leu or Val
  Variant (21)..(22): Xaa in position 21 to 22 is any amino acid
  Variant (23)..(23): Xaa in position 23 is Glu or Gly
  Variant (24)..(24): Xaa in position 24 is any amino acid
  Variant (25)..(25): Xaa in position 25 is Ile or Val
  Variant (26)..(27): Xaa in position 26 to 27 is any amino acid
  Variant (30)..(30): Xaa in position 30 is Glu or Arg
  Variant (31)..(31): Xaa in position 31 is Asn, Arg or Ser
  Variant (32)..(32): Xaa in position 32 is Ser or Thr
  Variant (35)..(35): Xaa in position 35 is Ile or Val
  Variant (37)..(37): Xaa in position 37 is any amino acid
  Variant (39)..(39): Xaa in position 39 is Met or Val
  Variant (41)..(41): Xaa in position 41 is Asn or Arg
  Variant (42)..(42): Xaa in position 42 is any amino acid
  Variant (43)..(43): Xaa in position 43 is Phe, Leu or Met
  Variant (44)..(44): Xaa in position 44 is any amino acid
  Variant (45)..(45): Xaa in position 45 is Gly or Thr
RXXXXXMXXIXXVXXXXPXXXXXXXXXDLXXXGSXEXTXEXXXXX

SEQ ID NO: 16105 - protein, 19 aa, Artificial sequence
  protein pattern
  Variant (2)..(2): Xaa in position 2 is Asp or Glu
  Variant (3)..(3): Xaa in position 3 is any amino acid
  Variant (5)..(6): Xaa in position 5 to 6 is any amino acid
  Variant (7)..(11): Xaa in position 7 to 11 is any or no amino acid
  Variant (13)..(13): Xaa in position 13 is any amino acid
  Variant (14)..(14): Xaa in position 14 is Leu, Met or Val
  Variant (15)..(15): Xaa in position 15 is Ala, Gly, Leu or Val
  Variant (16)..(16): Xaa in position 16 is any amino acid
  Variant (17)..(17): Xaa in position 17 is Phe, Ile or Leu
  Variant (18)..(18): Xaa in position 18 is Phe or Val
  Variant (19)..(19): Xaa in position 19 is Leu or Val
MXXSXXXXXXXLXXXXXXX

SEQ ID NO: 16106 - DNA, 1515 bp, SACCHAROMYCES CEREVISIAE
  CDS (1)..(1515)
atgtttgaaatgcgctacgtctatttgtttgcaatttgtattaagtttgtttcaagctccgaactaggaaaaatcaacaatctgctgcaaggaagattgatatacacagataattccgttgcgacaaatgtattagaatccaaatttccattcttgaaatcaacatgtgttaaagacgcactaaaattatttttgccacaatgtattgcaaatggacttgaatccattgacgctgaaacaagggtagaaacggccattaaactttcaatatgcgagtttcaggcatctggcttgggcgaaataccagaaaattgcatggttgacgacctaggatcaatgatggattgtatgtttgaactagaatcatcttcacagtggtggacaacttatagtggaaattatcagcgactatcgagtatttgttatgaaaatcttcttccttttgaaaaagaacagatactgaaactttttctaaatatcactgaactttatgattcatttggggatgatgtcgatactaagttaaatcatctgatgtttcaaatggagcaagattctcaaaattttttggacgatctggccaggatgttccgcaactatgacaatgaactgcgaaatgcgaccgaaagcaatcgaataatcttagaaaacgacctctcattttttagaaataaagtgaatgatgtactctatgaaacttccgaacaactagaggtccaaatcatagagaagaacagtcaactaatgaatgaagttgataccgtccatcatattatgagcgatctagccgatgagcttgctaaaaatgacataaaatctaagataaatgacttgaaggacgacagcctgaataatttacaggacctagtggaaatgtccaacgacgtaaaagaatattactctagaaataacaagttagttaataccgagttggaaaacttctcgatgggtttaaaaaaacagttaggaggcatgtcaaaggatctttctgaatcacaaatggaagctatagagctcttgcaagggttcaattccatccttcatgattcattgttaccatccatgacggatgagatagtacctgagatgacgaacttcaaaaataccttactacaagaatggacagctataacatctacactaaatggagattttgctttatggaatgaggagattttttcaacttttaatgatatttcagagaaactgaatggcacaaaaaaaaaattagacgacattgaaatcagagtctcacttgtccataaaaatgtcatgacaatgatgagggtattggattttatgtggaaaactagtaaaatgattataagatgtgggtaccttgcagtcaagaataaatactactggttactgtgctccgttgtgtggatttggtcaaaataccgtacgtctcgagtaaacgtcaaaatgattcctattaaacgctattaccaatgggcagctcttctactttcaatttatctaggagctaagactggctcattgattgatttttaa

SEQ ID NO: 16107 - protein, 504 aa, SACCHAROMYCES CEREVISIAE
MFEMRYVYLFAICIKFVSSSELGKINNLLQGRLIYTDNSVATNVLESKFPFLKSTCVKDALKLFLPQCIANGLESIDAETRVETAIKLSICEFQASGLGEIPENCMVDDLGSMMDCMFELESSSQWWTTYSGNYQRLSSICYENLLPFEKEQILKLFLNITELYDSFGDDVDTKLNHLMFQMEQDSQNFLDDLARMFRNYDNELRNATESNRIILENDLSFFRNKVNDVLYETSEQLEVQIIEKNSQLMNEVDTVHHIMSDLADELAKNDIKSKINDLKDDSLNNLQDLVEMSNDVKEYYSRNNKLVNTELENFSMGLKKQLGGMSKDLSESQMEAIELLQGFNSILHDSLLPSMTDEIVPEMTNFKNTLLQEWTAITSTLNGDFALWNEEIFSTFNDISEKLNGTKKKLDDIEIRVSLVHKNVMTMMRVLDFMWKTSKMIIRCGYLAVKNKYYWLLCSVVWIWSKYRTSRVNVKMIPIKRYYQWAALLLSIYLGAKTGSLIDF

SEQ ID NO: 16108 - DNA, 1437 bp, Ashbya gossypii
  CDS (1)..(1437)
atgctggaaattctgttgtttctctgcgtgatcatacaacggtcccacattaatgcagagatcacgcatgtagtgtctcatctcgccgagacagcgcttaggcaggacacaaatttccagctgttatcccaagatataattgccaagaagtttccaatactagattcgtcctgtgtgaggcgtgccctatcagactttttacctcagtgtcttcagtatgggttcgaaacggtgccaagtgatgtacgaactcaggcagcagtaaaactgtcaatatgtgaactgcaggcatctggtgtagacaatatgccgcctgaatgtgttggtgcggttcactttggcgcttgtcttcgagctatggagcgaaccccgcaatggtggacgacgtacagtggtaattatcagcatctgccgtcaacatgctttgagaatgccctcccatatgagaaagagcaactattaagcttgttcctaaatataaccgatgtttattctaatttccaggacgatctggttgtggacctggaaaagtaccgcgccaacttcgaggcaactgtggaggcaagcttaagactcatgaaagcaagtctcatggagggaacccatgagatagtaaaccagttgaaggatgatctaaattatgtgaattcaaaattggcagatatgggtaaaactattactgaacacacggataatgtccgtactgtattcaatgacatttcagatgaacttaacgactacgacatggcaggacagatagcgcatttgaaggaggatacaatgtcactctggcaaaaaataaacagtgacatgggaacatatcgcgatgtgcaaatgtcctcattgtataatatcaatgcggtgtttgatacgttctacaatagagccaccgaatcagtacagcaggtgagaacttctgtgatagaatcacaactagaaacgctggaccttattgcggactttaattcgctagtacgaaaatccattcttcctgtacttgctgatgagcttcaaccacaactacaagaaatgtccgtgtcaatttctagaagtttagtaggtttgagcgcaagctataatgaacatttacaggcatggagtaatagagttaacgagacactcagcgaaatggaatcgcatctgaataacgcaatgagccaggtagagcacatgaatgattccattgaaactctcgaaaacaaagtttttgttctagtctcactaggaaatgcgcttactacatacgttaaatggatatacacgttcagtcgtgcattaatatcaggatatggaatagttacattgataatgtcaatgttggtggtcagatattcaataaaactaaattcgagttggataaaggtccttggaagatctacatttatactagtagcagttgttcttggtgccagaacaggctcaatgctctcatattaa

SEQ ID NO: 16109 - protein, 478 aa, Ashbya gossypii
MLEILLFLCVIIQRSHINAEITHVVSHLAETALRQDTNFQLLSQDIIAKKFPILDSSCVRRALSDFLPQCLQYGFETVPSDVRTQAAVKLSICELQASGVDNMPPECVGAVHFGACLRAMERTPQWWTTYSGNYQHLPSTCFENALPYEKEQLLSLFLNITDVYSNFQDDLVVDLEKYRANFEATVEASLRLMKASLMEGTHEIVNQLKDDLNYVNSKLADMGKTITEHTDNVRTVFNDISDELNDYDMAGQIAHLKEDTMSLWQKINSDMGTYRDVQMSSLYNINAVFDTFYNRATESVQQVRTSVIESQLETLDLIADFNSLVRKSILPVLADELQPQLQEMSVSISRSLVGLSASYNEHLQAWSNRVNETLSEMESHLNNAMSQVEHMNDSIETLENKVFVLVSLGNALTTYVKWIYTFSRALISGYGIVTLIMSMLVVRYSIKLNSSWIKVLGRSTFILVAVVLGARTGSMLSY

SEQ ID NO: 16110 - DNA, 1464 bp, Kluyveromyces lactis
  CDS (1)..(1464)
atgtggtttcttgttttcagcatatggatcgcttccggtcaattactgccacatatttctaacgtaatagaaaaggagctcgatcaactagaaataacagagttatcccgtgaatacatcaataataaatttcccatcactcagtcaagctgtgttaaaaatgccttgggagagtttctcgaaatatgtatgaggaaaggtttcgaatttgttgatgcagatttgagagtcatcaccgcagtacgcttatcagtttgtgaatttgagtcatctgggttaaccaactacccaagcgaatgtcatgaaaaacgattaggtgggatagatactataagctgcgtcaatgctttggagtcatctccgcagtggtggacaacatacagtggaaactatcaaaatcttccacatatttgcatggagaattcgttaccgttcgaaaaggaacagatccttgagctattcttgaatattactgacatgtactcagaatttcaaagaaatatagaaaactattggaaaagttttagttctgatctagaaatcaatggtaaggagaatattgacatgatccaaaatttattcaattcactggtcaatgatttaatccaaaatcacaaaatgaaggacgaagaattaatcactgaatttgacaagatgaaggcagagtttgatatccgattctttaattttactgaatcatttgacaatctcaacgatgaggtgaatgaagatctatcattaataaaatctcacttaattgaaacttttcggcaagtcgactcagaatacatggcacaacttcaaaagaacaaaaattccacagacaaagccttcaatgaattagaatctatgtcgacttatatcttggatcaccagaagacatccatggaacttattgacagctttttctcagatctaatagacctaacccgtgataaaaatctagtaattagcgatgagttaatgcagacacaagaagaaactatacacctcatatttcaatacaataaactagtgcatgaatctgttataccattattgactgacgatcttttacctgtcgtcagaggtgtgtcaaattccattgttgaaaatttagacaacatgaatgttgaacttacaagccatttggaaaatgtatcacaaaccatcgaagtaaaatttaaggccttagaaaaggaaacagacagatctcttttaaaggcaaaagaggttgaatcaaatttgcgaaacttaaataaccttgtgagtacatccttgaaggggttacaaactattgtacggttattaacgtttttgttaaaacggcaggtcgttttggtagggatcctgcagatctttttaaggaaatacatctcgatgaatctatacctatacgcaatagcagtagttgtaacagcattagctggatctaaagtgggatcatggggctcattactaatgaaaagttttgtcactcgatag

SEQ ID NO: 16111 - protein, 487 aa, Kluyveromyces lactis
MWFLVFSIWIASGQLLPHISNVIEKELDQLEITELSREYINNKFPITQSSCVKNALGEFLEICMRKGFEFVDADLRVITAVRLSVCEFESSGLTNYPSECHEKRLGGIDTISCVNALESSPQWWTTYSGNYQNLPHICMENSLPFEKEQILELFLNITDMYSEFQRNIENYWKSFSSDLEINGKENIDMIQNLFNSLVNDLIQNHKMKDEELITEFDKMKAEFDIRFFNFTESFDNLNDEVNEDLSLIKSHLIETFRQVDSEYMAQLQKNKNSTDKAFNELESMSTYILDHQKTSMELIDSFFSDLIDLTRDKNLVISDELMQTQEETIHLIFQYNKLVHESVIPLLTDDLLPVVRGVSNSIVENLDNMNVELTSHLENVSQTIEVKFKALEKETDRSLLKAKEVESNLRNLNNLVSTSLKGLQTIVRLLTFLLKRQVVLVGILQIFLRKYISMNLYLYAIAVVVTALAGSKVGSWGSLLMKSFVTR

SEQ ID NO: 16112 - DNA, 25 bp, Artificial sequence
  primer
atgtttgaaatgcgctacgtctatt

SEQ ID NO: 16113 - DNA, 26 bp, Artificial sequence
  primer
ttaaaaatcaatcaatgagccagtct

SEQ ID NO: 16114 - DNA, 264 bp, Saccharomyces cerevisiae
  CDS (1)..(264)
atgactatcgctgaaataactataagacaaaagttctcttacccctttttatttggcaatgttttaggtcatccgtggccaagaaatgtgccaaggaaggaaattaaaatgcttttatttcgaaccgcaaataatagtttccccggatttttacttatttttacgagaaagcgaaggaacttaccaaaacaacgtgacaacgaaattccccgcacacgcgcattagaaacatatctacgggttttctctgccgctagaaaatag

SEQ ID NO: 16115 - protein, 87 aa, Saccharomyces cerevisiae
MTIAEITIRQKFSYPFLFGNVLGHPWPRNVPRKEIKMLLFRTANNSFPGFLLIFTRKRRNLPKQRDNEIPRTRALETYLRVFSAARK

SEQ ID NO: 16116 - DNA, 357 bp, Saccharomyces cerevisiae; identical to SEQ ID NO: 12327
  CDS (1)..(357)

SEQ ID NO: 16117 - protein, 118 aa, Saccharomyces cerevisiae; identical to SEQ ID NO: 12328

SEQ ID NO: 16118 - DNA, 26 bp, Artificial sequence
  primer
atgactatcgctgaaataactataag

SEQ ID NO: 16119 - DNA, 26 bp, Artificial sequence
  primer
ctattttctagcggcagagaaaaccc

SEQ ID NO: 16120 - DNA, 2118 bp, SACCHAROMYCES CEREVISIAE
  CDS (1)..(2118)
atgacaacaaactcacgtccatccgccttgcaggctcccggtttacagattttttccatgctgaaatcaagcgaagaggatggattcatgagttctagtctaacccttgatagtgataacataataggtgtcaccgagaacaatcgtcaagaattttactctacgtggcgaaaaccgtccctattaagcagccgcagcgtattacatgaatactcccctacaattgtgggatctaatgactgtactttttcacctataaccgtaggaaaaacaacgaagttttttaattgggatgatattatttcaagaattttcatgcaacagccattcggtgtaacacaccaattctttgaagaatttcggtattcaatcattacttctcattttttgaatgatatgaatcattacaggttatcactacatcttgatcaatctattatgaactttcataaaagctcaactttgttaaagaatgtacctcccaaatctgtaccatttatggcgacaaaatatggtaaattggcggtagcagaggacaaaaaattatatttcagacaaaatttcaactacctttcgatgattataacctcttatcgagtacttacacagttgaaaaaatactgtagaaaaaaaaatagtccaggtctgaagagagttgtaattttaatactcgtagcagtgtatttatcaattcagcaagaatactttcgaagacatttgatttgctataaaaccttattaaaggtacggaaagtgctcgaatcattacaacaagtggatgtaatgattcataaatatcatcttcgatttaaagaaataaaaaatcatagttttatatcaagagtgtctcttatttcaattgctgacgagcactcatctgtgataaaagagctcctagtattctcaagtgatgcactgttttataaactcaaatcaatcattccagatattgtcatctttagcgatacaagtgagctatcgaaatactgtgaattatacggtatcgatgtaccaaatctttactataataatactaccacagtaaaagaccttgatggtaagctttatcgtctcaaactgctaaagaaatttatgctctgttgtttgctgtctttagatatgacaggaaacgaaaatctttcaaatgtaaacatgagaaacgcactaaacaaaatctttccagattacatggcaagggtgcaactcaaaaaaaaatataatccaataggtacattccaaaatatagttagtctattaagaggattacattcactactctccactgtcctggtgtctttgaatgaccataagcaaatattgtatgcatttcctgaagaaacatcaactaatactggttgtgaaagagcaaatgtatgttcattttcaaagaatgataaattgtttcaggcacttaattacttaaaaatgatcgagaacaatctattagctattgacattcgaaatggcataacagagaatgataggaacatcattgaggataagttggaggagctcattactttctggaaaacctcgaaaatttgtggcaatatttctaggatacaaaaggtatccccaaccaatacaatcaaccatggtttccatctggatatcctcaaaggcagaaagtcaccccgttcttcgtcagtacaaggtcttagcttagagaggaaagttgacttcattgatgttgctgaatcggtgaatgactcttttgaaaacgacaccgaactagaggaatatgaagactacgactgtcaggaggaatgttctgccggttcacgccaaaatcaccgcgtagattttatcggaaaggatagttgtaggaaaccagatttcaagcaactttctgacaacgaattacgacgcaagttagatgaaagaattttgaaattggctcaagaaaaccgtgaaggcagggaaaggctaagaactgcaaagtcctttgaattgctaagaaaagctcaggcttccatgtccgtaaagtttggctttcaaaaaccattaagagacgatgcctttcttgagagcaggcctctcagcaaatgcaaagtatcttcggaagaaactatcccatttttgtatgaattaaaaggattactaggaaatgattcatga

SEQ ID NO: 16121 - protein, 705 aa, SACCHAROMYCES CEREVISIAE
MTTNSRPSALQAPGLQIFSMLKSSEEDGFMSSSLTLDSDNIIGVTENNRQEFYSTWRKPSLLSSRSVLHEYSPTIVGSNDCTFSPITVGKTTKFFNWDDIISRIFMQQPFGVTHQFFEEFRYSIITSHFLNDMNHYRLSLHLDQSIMNFHKSSTLLKNVPPKSVPFMATKYGKLAVAEDKKLYFRQNFNYLSMIITSYRVLTQLKKYCRKKNSPGLKRVVILILVAVYLSIQQEYFRRHLICYKTLLKVRKVLESLQQVDVMIHKYHLRFKEIKNHSFISRVSLISIADEHSSVIKELLVFSSDALFYKLKSIIPDIVIFSDTSELSKYCELYGIDVPNLYYNNTTTVKDLDGKLYRLKLLKKFMLCCLLSLDMTGNENLSNVNMRNALNKIFPDYMARVQLKKKYNPIGTFQNIVSLLRGLHSLLSTVLVSLNDHKQILYAFPEETSTNTGCERANVCSFSKNDKLFQALNYLKMIENNLLAIDIRNGITENDRNIIEDKLEELITFWKTSKICGNISRIQKVSPTNTINHGFHLDILKGRKSPRSSSVQGLSLERKVDFIDVAESVNDSFENDTELEEYEDYDCQEECSAGSRQNHRVDFIGKDSCRKPDFKQLSDNELRRKLDERILKLAQENREGRERLRTAKSFELLRKAQASMSVKFGFQKPLRDDAFLESRPLSKCKVSSEETIPFLYELKGLLGNDS

SEQ ID NO: 16122 - DNA, 1959 bp, Ashbya gossypii
  CDS (1)..(1959)
atgtattatactccgaaagggttgctttccgggaggccaggccagacgatggttcgggagagcgagagcgcgacgggcggggaagggatatacgccggatcccctttgggaaacgccttggactggggtatcgatgtctacaccgaccggtcgccgacagttgtgaacgacgacttcgaaccgctagactcgactatggacgagctgtttctgttccccacttgccgcgacagttattcaggcacgccaatgggagagttgatacggcgggtgttcgagcacggggcgcttggtggggagcattttttagaggagttccagtacaccataattacttcgaaaggcttgaacgtgaatggcatgacagctccggtgtcctcggttacggggatatcggagctaaataatcagaatgcgggccctggaaagaccatggttcacgccccgacaaagtatggacggttggtaggcagccggaaggtgctatacctccggaagacggtttcctttctcccggtagcgcttttttgtgtgcgatgctttaggcgcttgcttttggtacgctccaagagccggaagaacataatagttgcattattggtcgccatatatcttgccctacagcaggagaactttcattccaggtacgtcagacatgctactatgatgaacttgggcaaaatgttgaacagttggagtgatgtagaggcgcggatgcacaggtatcatattcggttaaaggaattgacgatatacagacccattacgctcaccggaggcaagccacccacttaccccacaaataatcattcactgttggcagatttgttaaacatggcctcggacatgctatactacaagataaaacacattgttacggaattattatcacttgccgacacagaaaatctggttcattactgtggtatatatgacgtgaacatggtgaccctatatgggtatttgcatacaacatctgatcttggtacagcggataagattaaccgcttgcagttactcaagaaatttagtttatgcattcttttatcaataacaaggtttgatagaattgtgaccacacgttcggctgtggtactgaaactctttccaaactacaaacacagatatatgaaagaaacggagaagcttctacttctttcgaaagccctaggagacgtagctgactgtctgaatgaagtatctaaagtgctagaaagctataagtcacaattaaaatatattgaaacatcgataaatgaccagcataataatgtattacctcaaccagtcatgattgaaagtggattagagagagtaacagttactttgaacgaattaaatgaaatacagaacaagttgttccacgcagagagcgatgatgagactctgcgtaaatttgtccaggaaaagctacacgaattatgtcatttttgggaacacacgacaacgaagaagccgacgtcactactgcctcctcaggtaacatcaccacatcggcaatttcacaacacgtccaatggatttgtgttaaacgttgttaaggcgattgagacaaatcctgcaatggccccccagctcacaagctatgagcctgtaaccccggccggcagcgagtcatgcctcgaacaggacttcctagaatccaatttttcgactgaatcgggggaacatatatactctacagcagatgaagaaacagtagcccctcagtacctggtggataggtttgataaactttcccacgaagagctgcgtctgcgtttggatgagcaattcaagcgcttgactgtagatactaagccgccgaaacagcactcgaaaaaggatcgcttggaagtcttgaatatgaacgttagggatggcagtaataacggatatgagagcgggcctttctattcaaaggaggaaagtattcctgtactatatgaactcaaccagctactgtcgaatagaaggtag

SEQ ID NO: 16123 - protein, 652 aa, Ashbya gossypii
MYYTPKGLLSGRPGQTMVRESESATGGEGIYAGSPLGNALDWGIDVYTDRSPTVVNDDFEPLDSTMDELFLFPTCRDSYSGTPMGELIRRVFEHGALGGEHFLEEFQYTIITSKGLNVNGMTAPVSSVTGISELNNQNAGPGKTMVHAPTKYGRLVGSRKVLYLRKTVSFLPVALFCVRCFRRLLLVRSKSRKNIIVALLVAIYLALQQENFHSRYVRHATMMNLGKMLNSWSDVEARMHRYHIRLKELTIYRPITLTGGKPPTYPTNNHSLLADLLNMASDMLYYKIKHIVTELLSLADTENLVHYCGIYDVNMVTLYGYLHTTSDLGTADKINRLQLLKKFSLCILLSITRFDRIVTTRSAVVLKLFPNYKHRYMKETEKLLLLSKALGDVADCLNEVSKVLESYKSQLKYIETSINDQHNNVLPQPVMIESGLERVTVTLNELNEIQNKLFHAESDDETLRKFVQEKLHELCHFWEHTTTKKPTSLLPPQVTSPHRQFHNTSNGFVLNVVKAIETNPAMAPQLTSYEPVTPAGSESCLEQDFLESNFSTESGEHIYSTADEETVAPQYLVDRFDKLSHEELRLRLDEQFKRLTVDTKPPKQHSKKDRLEVLNMNVRDGSNNGYESGPFYSKEESIPVLYELNQLLSNRR

SEQ ID NO: 16124 - DNA, 2001 bp, Candida glabrata
  CDS (1)..(2001)
atggatagcggtgctacatcgtttaatgtactgggtgaatggcgacgtacagtacagtccaagttgctgggtgaaaggcatgttggatttgtagcagaagaaaataaattgcattgcggtagcattaaagatcgagatagtgtagtattgacacccattgccaatattcaacaaggcactgtaaattacaaccatatgtttgacaatttgatatgggtctcagatgtacaattcatggaagaactccaatatacattgatctcgtcaccgttcttaaatgatatacaccatcatcaaatgcccttatcggtagcaaattctataatggacttccatcgagacaggagatttcacagagaaagctttatttttagcgtgccaacaaaattggggtatttaaaggctaggtatggggataaaaaactggaattgcgaaagaacattaacttcatggatgtccataagactgtatactccatccttaaacacttgagaaataacaataaaaagtgtacatggcgtatcctatccgttttaatgataatactttacctcggctacgaacaagctcattttcataatcagtatcccaaatacagtttcttaacacaactgaaagcaatgatgggaaaactacaacagtttgacagcattcaaagaaagtactttgaaaatatcaacatcacaaaggaatttgataaaactggaaatgaaatatttcagttattacattcaataacgcatatagcatctatgaaactttaccatttatcagaatttttactacggttcacaaacatcggaaaattatcaaagtattgtggtgtatatggtattgacatgaacttagcatatttaacaaatgtcaggatcttaacatctactaaacaagaattacatttattacaagacaagatcgaatttttaaggaagttcttattatgctgttttctatcagtggagcaccaagattataacgaaaaggttaagaatattatcttttccacctatctattaaaactctttcctggatacactgaagataataattgcaagtccttattttcttcacaatggtctgtgttatcaaccgtgatagtaaaatttaatcaagatttaagctttttatactcagtgttaaatgaaaataaagagcttatatattctaccgaaaccagagaagagtcagaaactgatgaaatgctaaaagaaagatacaaattcagatataaagataagaatcaatcattaatgcttaaggcattaagtcaaatccatctagtagaggagcaattgatttctgtgcaggacgcagatgacaatgaagaaactaaatgcttgatcaacgatcatatcaaaaatctccaacagctgatattgtgttgtaataataagacaaattctggtacaaacttcagcaaccgccatactagcttacaagggaaagggttatttttagatgtcctgaaatcaccagaggagaaatttacacctatttttcaggaaatggaagtatctcgtattgggataaaaaacgtcagtgataatgatgacctcgaaagtattttaacagacaacgagaattatgaacatatagagccagcgcatttcatcgatgacagaaacaacggcggggcttttacaatatatgaagattcgacatgttatgctgacgattgttacaaaaatgcttctgaactcaggaaattaaatgatgagcaacttcggcggaaattaaatgaaaaaattcagttatttgctactgaaaacaagaaaaatcgaaatcaaatacgacagcagaagtctttagaactcttgagaagtaatagtacactgacagcgttaaatgagcttaaaagcaatactaattatgaatcattggataaaggagttaaaacaaaaaaaagagcacactttatggaacaggaattgtactcagaggagactattcctttttactatgagataaacgacttcctttacaatcaggccaatcagtga

SEQ ID NO: 16125 - protein, 666 aa, Candida glabrata
MDSGATSFNVLGEWRRTVQSKLLGERHVGFVAEENKLHCGSIKDRDSVVLTPIANIQQGTVNYNHMFDNLIWVSDVQFMEELQYTLISSPFLNDIHHHQMPLSVANSIMDFHRDRRFHRESFIFSVPTKLGYLKARYGDKKLELRKNINFMDVHKTVYSILKHLRNNNKKCTWRILSVLMIILYLGYEQAHFHNQYPKYSFLTQLKAMMGKLQQFDSIQRKYFENINITKEFDKTGNEIFQLLHSITHIASMKLYHLSEFLLRFTNIGKLSKYCGVYGIDMNLAYLTNVRILTSTKQELHLLQDKIEFLRKFLLCCFLSVEHQDYNEKVKNIIFSTYLLKLFPGYTEDNNCKSLFSSQWSVLSTVIVKFNQDLSFLYSVLNENKELIYSTETREESETDEMLKERYKFRYKDKNQSLMLKALSQIHLVEEQLISVQDADDNEETKCLINDHIKNLQQLILCCNNKTNSGTNFSNRHTSLQGKGLFLDVLKSPEEKFTPIFQEMEVSRIGIKNVSDNDDLESILTDNENYEHIEPAHFIDDRNNGGAFTIYEDSTCYADDCYKNASELRKLNDEQLRRKLNEKIQLFATENKKNRNQIRQQKSLELLRSNSTLTALNELKSNTNYESLDKGVKTKKRAHFMEQELYSEETIPFYYEINDFLYNQANQ

SEQ ID NO: 16126 - DNA, 2001 bp, Kluyveromyces lactis
  CDS (1)..(2001)
atggacattttccaagcggtgcctttgcatctgcaaatccctaggattgaaattcccaaaatggcatctgcagcatcgactccatcaacgatgtcttcgtcacagacttggagcagttcacgcccacaagttccgatcagttaccagcagttgcgcaagcttagtgagtggggtattgaggctttgaaggacacttcgccgactgttgtaggccaagatcgctttgaatcacaggagattctgattgataacgattacagaactgattttctgaactcacatgaagaagatagccgatggagtaaacaagtagatttgatcatgaagcagctaccttatggtgacctggatgcctttgttgatgaatttcactatgaaatcatttcctcgcaactgttaacaagctcgatcgcttctcatcaccagttatttactgttcagaaatcaatcctgaacttcaataaggaaaacaccctatcgattcacaacgctgaaggaaagactatacctacaaaatatggacaattgttaatttctggaaaaaaattctatttacagagaacaattccatacatgttcaccatattgacggcaagaaaagctttccgtaaaatgctttataagagacatctacctagatcctctctgatgtccttattgatgattgctgtttatctagctttacagcaagagtacttccatgcaaaatattccaaatacactgcccttttaaatctacgacagatgaatgctgcattgcaatctgtagacaaattaatctatcgttatcacctgacttataaagagctgactatttacaaaccaatcgcattgactgaaaatcgtggtctacgttcagatgaagccagaacactgacattactaacagatgtccttacatgtacagtagaccagttatttcacaaattgaacattgcatctagtaacattttgccggttgtgaatgcagttcagttaactgattatatcagtatttacaatgtggatttgcaaagcctatatcaaatgatccgaacagtggaaagtctggacattacacaaaagttggagagattgcaatatatgagaaagttctttctgtgctgcttactttcaataaactacactgatccactgaaaaagtgtgagattgcattagtcttgaagagaatttttcctggataccatgtggaaaagacttccgacatagagcgatttcaaataatctcgaaacaattatacacattaacacaaggtatctcatcattgttgcccgttttgcatcattacaaacatttacttttatccgtgtacggaagtactattgaaaaagaggatcccgaatcaaaggaagctgtaataacccaaagtatctatcgcttgtctgaattgcagcgatacttgatgaaacaggacaaaacatctaccgaactctcttctcacctgatagatgagttgaatggaataatacaaatatggaatatcgactataaacataactcgcatgaacagttgaaaccaccgaaatgttctcctcggccttccagtcagagagttttcagcggtggactcaatcttgatatcgtaaagacgaccagtgatatccccgtggtagttgattcatttccgaaactcacttcgctagtagacgtgttagaagtagatgaaactgggtcagacattgaaaaagaacatgaggaattggtgtacggtactgaaaatgatcaagaaacagcttctagcaacgactctaagttttctcgttttacagacgaccagttaaggcacgaattaaaccaacgaatactgaatctgtcaattgaaaataagaaaagtagagaaaacttgagaaaacagaaaagttttgagctgatgaatcggaaaatagaaaatcagaagaagggcaggccccagatagattgcaaaggtcttttcaattccgaagagagtataccagtacttttcgaactaaaacaatttttaaacagaagaagtgattga

SEQ ID NO: 16127 - protein, 666 aa, Kluyveromyces lactis
MDIFQAVPLHLQIPRIEIPKMASAASTPSTMSSSQTWSSSRPQVPISYQQLRKLSEWGIEALKDTSPTVVGQDRFESQEILIDNDYRTDFLNSHEEDSRWSKQVDLIMKQLPYGDLDAFVDEFHYEIISSQLLTSSIASHHQLFTVQKSILNFNKENTLSIHNAEGKTIPTKYGQLLISGKKFYLQRTIPYMFTILTARKAFRKMLYKRHLPRSSLMSLLMIAVYLALQQEYFHAKYSKYTALLNLRQMNAALQSVDKLIYRYHLTYKELTIYKPIALTENRGLRSDEARTLTLLTDVLTCTVDQLFHKLNIASSNILPVVNAVQLTDYISIYNVDLQSLYQMIRTVESLDITQKLERLQYMRKFFLCCLLSINYTDPLKKCEIALVLKRIFPGYHVEKTSDIERFQIISKQLYTLTQGISSLLPVLHHYKHLLLSVYGSTIEKEDPESKEAVITQSIYRLSELQRYLMKQDKTSTELSSHLIDELNGIIQIWNIDYKHNSHEQLKPPKCSPRPSSQRVFSGGLNLDIVKTTSDIPVVVDSFPKLTSLVDVLEVDETGSDIEKEHEELVYGTENDQETASSNDSKFSRFTDDQLRHELNQRILNLSIENKKSRENLRKQKSFELMNRKIENQKKGRPQIDCKGLFNSEESIPVLFELKQFLNRRSD

SEQ ID NO: 16128 - DNA, 24 bp, Artificial sequence
  primer
atgacaacaaactcacgtccatcc

SEQ ID NO: 16129 - DNA, 26 bp, Artificial sequence
  primer
tcatgaatcatttcctagtaatcctt

SEQ ID NO: 16130 - protein, 665 aa, Artificial sequence
  consensus sequence
  Variant (2)..(31): Xaa in position 2 to 31 is any amino acid
  Variant (32)..(53): Xaa in position 32 to 53 is any or no amino acid
  Variant (55)..(56): Xaa in position 55 to 56 is any amino acid
  Variant (58)..(59): Xaa in position 58 to 59 is any amino acid
  Variant (61)..(62): Xaa in position 61 to 62 is any amino acid
  Variant (64)..(64): Xaa in position 64 is any amino acid
  Variant (66)..(67): Xaa in position 66 to 67 is any amino acid
  Variant (69)..(82): Xaa in position 69 to 82 is any amino acid
  Variant (83)..(84): Xaa in position 83 to 84 is any or no amino acid
  Variant (86)..(103): Xaa in position 86 to 103 is any amino acid
  Variant (104)..(107): Xaa in position 104 to 107 is any or no amino acid
  Variant (110)..(110): Xaa in position 110 is any amino acid
  Variant (112)..(112): Xaa in position 112 is any amino acid
  Variant (114)..(117): Xaa in position 114 to 117 is any amino acid
  Variant (118)..(119): Xaa in position 118 to 119 is any or no amino acid
  Variant (121)..(163): Xaa in position 121 to 163 is any amino acid
  Variant (164)..(167): Xaa in position 164 to 167 is any or no amino acid
  Variant (170)..(172): Xaa in position 170 to 172 is any amino acid
  Variant (174)..(175): Xaa in position 174 to 175 is any amino acid
  Variant (177)..(205): Xaa in position 177 to 205 is any amino acid
  Variant (207)..(226): Xaa in position 207 to 226 is any amino acid
  Variant (227)..(241): Xaa in position 227 to 241 is any or no amino acid
  Variant (243)..(251): Xaa in position 243 to 251 is any amino acid
  Variant (253)..(268): Xaa in position 253 to 268 is any amino acid
  Variant (270)..(271): Xaa in position 270 to 271 is any amino acid
  Variant (273)..(275): Xaa in position 273 to 275 is any amino acid
  Variant (277)..(283): Xaa in position 277 to 283 is any amino acid
  Variant (285)..(287): Xaa in position 285 to 287 is any amino acid
  Variant (288)..(291): Xaa in position 288 to 291 is any or no amino acid
  Variant (293)..(309): Xaa in position 293 to 309 is any amino acid
  Variant (312)..(312): Xaa in position 312 is any amino acid
  Variant (315)..(316): Xaa in position 315 to 316 is any amino acid
  Variant (319)..(336): Xaa in position 319 to 336 is any amino acid
  Variant (337)..(340): Xaa in position 337 to 340 is any or no amino acid
  Variant (343)..(343): Xaa in position 343 is any amino acid
  Variant (345)..(375): Xaa in position 345 to 375 is any amino acid
  Variant (376)..(380): Xaa in position 376 to 380 is any or no amino acid
  Variant (382)..(384): Xaa in position 382 to 384 is any amino acid
  Variant (386)..(421): Xaa in position 386 to 421 is any amino acid
  Variant (422)..(432): Xaa in position 422 to 432 is any or no amino acid
  Variant (434)..(483): Xaa in position 434 to 483 is any amino acid
  Variant (484)..(487): Xaa in position 484 to 487 is any or no amino acid
  Variant (489)..(490): Xaa in position 489 to 490 is any amino acid
  Variant (492)..(494): Xaa in position 492 to 494 is any amino acid
  Variant (496)..(558): Xaa in position 496 to 558 is any amino acid
  Variant (559)..(579): Xaa in position 559 to 579 is any or no amino acid
  Variant (582)..(583): Xaa in position 582 to 583 is any amino acid
  Variant (585)..(607): Xaa in position 585 to 607 is any amino acid
  Variant (608)..(608): Xaa in position 608 is any or no amino acid
  Variant (610)..(631): Xaa in position 610 to 631 is any amino acid
  Variant (632)..(651): Xaa in position 632 to 651 is any or no amino acid
  Variant (654)..(654): Xaa in position 654 is any amino acid
  Variant (657)..(659): Xaa in position 657 to 659 is any amino acid
  Variant (661)..(664): Xaa in position 661 to 664 is any amino acid
SXXXXXXXXXXXXXXXXXXXXXXXXXXXXXXXXXXXXXXXXXXXXXXXXXXXXFXXEXXYXXIXSXXLXXXXXXXXXXXXXXXXIXXXXXXXXXXXXXXXXXXXXXXTKXGXLXXXXXXKXXXXXXXXXXXXXXXXXXXXXXXXXXXXXXXXXXXXXXXXXXXXXXXYLXXXQXXFXXXXXXXXXXXXXXXXXXXXXXXXXXXXXYXXXXXXXXXXXXXXXXXXXXXXXXXXXXXXXXXXXLXXXXXXXXXKXXXXXXXXXXXXXXXXLXXYXXXYXXXXXXXYXXXXXXXTXXXXXXXXXXXXXXXXXKFXLCXXLSXXXXXXXXXXXXXXXXXXXXXXFPXYXXXXXXXXXXXXXXXXXXXXXXXXXXXXXXXXXXXXLXXXKXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXGXXLXXXKXXXXXXXXXXXXXXXXXXXXXXXXXXXXXXXXXXXXXXXXXXXXXXXXXXXXXXXXXXXXXXXXXXXXXXXXXXXXXXXXXXXXLRXXLXXXXXXXXXXXXXXXXXXXXXXXXEXXXXXXXXXXXXXXXXXXXXXXXXXXXXXXXXXXXXXXXXXXEEXIPXXXEXXXXL

SEQ ID NO: 16131 - protein, 40 aa, Artificial sequence
  protein pattern
  Variant (3)..(4): Xaa in position 3 to 4 is any amino acid
  Variant (5)..(5): Xaa in position 5 is any or no amino acid
  Variant (7)..(8): Xaa in position 7 to 8 is any amino acid
  Variant (9)..(9): Xaa in position 9 is any or no amino acid
  Variant (11)..(11): Xaa in position 11 is His or Arg
  Variant (12)..(16): Xaa in position 12 to 16 is any amino acid
  Variant (17)..(17): Xaa in position 17 is His or Tyr
  Variant (18)..(19): Xaa in position 18 to 19 is any amino acid
  Variant (20)..(20): Xaa in position 20 is Leu or Met
  Variant (21)..(22): Xaa in position 21 to 22 is any amino acid
  Variant (23)..(23): Xaa in position 23 is Leu or Val
  Variant (24)..(25): Xaa in position 24 to 25 is any amino acid
  Variant (26)..(26): Xaa in position 26 is Met or Val
  Variant (27)..(27): Xaa in position 27 is any amino acid
  Variant (28)..(28): Xaa in position 28 is Ala, Glu, Gly or Asn
  Variant (29)..(30): Xaa in position 29 to 30 is any amino acid
  Variant (31)..(31): Xaa in position 31 is Gln or Ser
  Variant (32)..(32): Xaa in position 32 is Asp, Gln or Ser
  Variant (33)..(33): Xaa in position 33 is Phe or Val
  Variant (34)..(34): Xaa in position 34 is Asp or Glu
  Variant (35)..(38): Xaa in position 35 to 38 is any amino acid
  Variant (39)..(39): Xaa in position 39 is Lys or Arg
YLXXXQXXXFXXXXXXXXXXXXXXXXXXXXXXXXXXXXXY

SEQ ID NO: 16132 - protein, 20 aa, Artificial sequence
  protein pattern
  Variant (2)..(5): Xaa in position 2 to 5 is any or no amino acid
  Variant (7)..(7): Xaa in position 7 is any or no amino acid
  Variant (9)..(9): Xaa in position 9 is any amino acid
  Variant (12)..(12): Xaa in position 12 is any amino acid
  Variant (13)..(13): Xaa in position 13 is Phe or Leu
  Variant (16)..(16): Xaa in position 16 is Ile, Leu or Val
  Variant (17)..(17): Xaa in position 17 is Asp, Glu, Asn or Thr
  Variant (18)..(19): Xaa in position 18 to 19 is any amino acid
  Variant (20)..(20): Xaa in position 20 is Asp or Gly
RXXXXKXFXLCXXLSXXXXX

SEQ ID NO: 16133 - DNA, 324 bp, Saccharomyces cerevisiae
  CDS (1)..(324)
atgcatcagcaacactcccaaaggaaaaaattcgaaggccctaaaagagaagctattctggatttagcgaagtataaagattctaaaattcgcgtcaaattaatgggtggtaaattagttataggtgtcctaaaaggctatgatcaactgatgaacttggtacttgatgatacagtagaatatatgtctaatcctgatgatgaaaacaacactgaactgatttctaaaaacgcaagaaagctaggtttgaccgtcataagaggtactattttggtctctttaagttccgccgaaggttctgatgtactatatatgcaaaaatag

SEQ ID NO: 16134 - protein, 107 aa, Saccharomyces cerevisiae
MHQQHSQRKKFEGPKREAILDLAKYKDSKIRVKLMGGKLVIGVLKGYDQLMNLVLDDTVEYMSNPDDENNTELISKNARKLGLTVIRGTILVSLSSAEGSDVLYMQK

SEQ ID NO: 16135 - DNA, 553 bp, Triticum aestivum
  CDS (103)..(492)
  misc_feature (505)..(505): n is a, g, c or t
  misc_feature (507)..(507): n is a, g, c or t
  misc_feature (515)..(515): n is a, g, c or t
gcatgaacgacgtcgcacgacgccagtcgacgacttgtcgcgccaaacttaccagcagctgatattacactcacctacgccgtcatctgacgtcgctgaaacatgtcagaacgaggaaatcatcggggaagccgccgcggtggccgtggaggggcgggccgtggcagccatgaaggcggccgaggagcacatggtgggcagggcgctgaacgagcaaaaaaggagaatatcctcgacctcagcaagtacctggaccagaagattgccgtgaagttcacaggtggccgtgaagttacaggcacactgaaaggttatgatgctctcatgaatctcgtgctcgatgacgtagaagaaatgatgcacgacgaagaaaacaaaattaccacccgaccgctcggtctcatcgttgcgcgagggactcttcttgttctaataagccccatggatgggagtgaagagattccgaacccatttgtgcaacctgaagactgatctagaagagaangnggcaatanttgggggtatccaatttgtaatatcctcctgacctgcg

SEQ ID NO: 16136 - protein, 129 aa, Triticum aestivum
MSERGNHRGSRRGGRGGAGRGSHEGGRGAHGGQGAERAKKENILDLSKYLDQKIAVKFTGGREVTGTLKGYDALMNLVLDDVEEMMHDEENKITTRPLGLIVARGTLLVLISPMDGSEEIPNPFVQPED

SEQ ID NO: 16137 - DNA, 444 bp, Gossypium hirsutum
  CDS (33)..(332)
  misc_feature (423)..(423): n is a, g, c or t
  misc_feature (425)..(425): n is a, g, c or t
cttaacacaaaggtgccagaactacctacaacatgtcaggcaggaaggaaacagtgttggatttggctaagtttgttgacaaaggtgttcaggtcaaactcaccggtggtagacaagtcacagggaccctaaaaggatacgaccagctactgaatcttgtcctggatgaagctgtagagtttcttcgagaccaggatgatccgttgaagactactgatcagactaggcgtcttggcttgatagtttgtaggggcacagcagtcatgctggtgtcacctaccgatggcacagatgagattgccaatcctttcatccagccagatggagcctgatctgatccgttttcaaaatatggcatttcctttgctctactacttatatattctcttaacattttcaagtctgtatttctatgagcatgtngntatctcttttgaagctacc

SEQ ID NO: 16138 - protein, 99 aa, Gossypium hirsutum
MSGRKETVLDLAKFVDKGVQVKLTGGRQVTGTLKGYDQLLNLVLDEAVEFLRDQDDPLKTTDQTRRLGLIVCRGTAVMLVSPTDGTDEIANPFIQPDGA

SEQ ID NO: 16139 - DNA, 366 bp, Gossypium hirsutum
  CDS (23)..(265)
  misc_feature (323)..(323): n is a, g, c or t
cccacgcgtccgctctttcacaatgagcagatccggccagcctccagatctcaaaaagtacatggacaagaagctccagattaagctgaatgcaaatcggttggttgttggaacacttcgcggatttgatcagtttatgaacctagtagttgacaacaccgttgaggtgaatggcaatgagaaaactgacataggcatggtggtgatcagaggaaatagcgttgttactgttgaagcacttgagcccgtaggccggatgcagtaatttaggtttttcgttccaaaacttggatttcactttctgtatctctttcactctttgngtctagcctgctagcttcgggcttcatatgttacatgatcgag

SEQ ID NO: 16140 - protein, 80 aa, Gossypium hirsutum
MSRSGQPPDLKKYMDKKLQIKLNANRLVVGTLRGFDQFMNLVVDNTVEVNGNEKTDIGMVVIRGNSVVTVEALEPVGRMQ

SEQ ID NO: 16141 - DNA, 303 bp, Zea mays
  CDS (1)..(303)
atggcggggcgcaaggagacggcgctcgacctggccaagttcgtcgacaagggcgtccaggtcaagctcaccggcggccgccaagttacaggaaccttgaagggatatgaccagctgctcaacttagtgctggatgaagcagtcgagtctgaaagagagcaagatgacccgttgaagctgtcaaccaagaccagacaacttggtctcattgtgtgcagaggcactgctgtcatgctggtgtcaccaactgatggaaccgacgagattgccaaccccttcctcgcagcggagggggcgtcataa

SEQ ID NO: 16142 - protein, 100 aa, Zea mays
MAGRKETALDLAKFVDKGVQVKLTGGRQVTGTLKGYDQLLNLVLDEAVESEREQDDPLKLSTKTRQLGLIVCRGTAVMLVSPTDGTDEIANPFLAAEGAS

SEQ ID NO: 16143 - DNA, 297 bp, Zea mays
  CDS (1)..(297)
atggctgggcgcaaggagaccgcactcgacctggcgaagttcgtcgacaagggcgtccaggtgaagctcaccggcggccgccaagtgacaggaactttaaagggatatgaccagctactcaacctagtgctagatgaagcagttgaatatgaaagagagcaagatgacccattgaagctatcagggaaaaccagacagcttggcctcattgtgtgcagaggcacggcagtcatgctggtctcaccgactgatggaactgatgagatcgccaacccttttcttgcggaaggagcataa

SEQ ID NO: 16144 - protein, 98 aa, Zea mays
MAGRKETALDLAKFVDKGVQVKLTGGRQVTGTLKGYDQLLNLVLDEAVEYEREQDDPLKLSGKTRQLGLIVCRGTAVMLVSPTDGTDEIANPFLAEGA

SEQ ID NO: 16145 - DNA, 297 bp, Zea mays
  CDS (1)..(297)
atggctgggcgcaaggaaactgcactcgacctggcgaagttcgtcgacaagggcgtccaggtgaagctcaccggcggccgccaagtgacaggaactctaaagggatatgaccaactactcaacttagtgctagatgaagcagttgagaatgaaagagagcaagatgatccattgaagctatcagggaaaactagacaacttggcctcattgtgtgcagaggcacggcagtcatgctggtctcaccgactgatgggactgatgagatcgccaaccctttcctcgcggacggagcatag

SEQ ID NO: 16146 - protein, 98 aa, Zea mays
MAGRKETALDLAKFVDKGVQVKLTGGRQVTGTLKGYDQLLNLVLDEAVENEREQDDPLKLSGKTRQLGLIVCRGTAVMLVSPTDGTDEIANPFLADGA

SEQ ID NO: 16147 - DNA, 300 bp, Glycine max
  CDS (1)..(300)
atgtcgggcaaaaaggaaacggttttggcccttccaaagtttgtagccaaaggggttccagttaagcttcctgggggcacccaagtgccagggccttttaaagggtttggtccgttgtttacccttgtcctagaggaagcgggagggtttttaaggggtcctgatggtccccccaaaactcccggtcaggcccgaaattttgggttaattgtttgtagaggaactcctgtcatgcttgggtccccccctgatgggcccaatgggatcccccccccctttttccagcccgatgggttttaa

SEQ ID NO: 16148 - protein, 99 aa, Glycine max
MSGKKETVLALPKFVAKGVPVKLPGGTQVPGPFKGFGPLFTLVLEEAGGFLRGPDGPPKTPGQARNFGLIVCRGTPVMLGSPPDGPNGIPPPFFQPDGF

SEQ ID NO: 16149 - DNA, 246 bp, Sorghum bicolor
  CDS (1)..(246)
atgagccgctcgggacagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcccagcagtga

SEQ ID NO: 16150 - protein, 81 aa, Sorghum bicolor
MSRSGQPPDLKKYMDKKLQIKLNANRVVIGTLRGFDQFMNLVVDNTVEVNGNDKTDIGMVVIRGNSVVMIEALEPVAKSQQ

SEQ ID NO: 16151 - DNA, 300 bp, Glycine max
  CDS (1)..(300)
atgtcgggcagaaaggaaacggttttggaccttgcaaagtttgtagacaaaggcgttcaagttaagcttactggtggcagacaagtgacagggactctgaaagggtatgatcagttgcttaaccttgtcctagatgaagctgtagagtttttaagagatcctgatgatcccctcaaaactaccgatcagaccagaaatcttggcttaattgtttgtagaggaactgctgtcatgcttgtgtccccaactgatggtacagatgagatcgccaacccctttatacagccagatgggtcttaa

SEQ ID NO: 16152 - protein, 99 aa, Glycine max
MSGRKETVLDLAKFVDKGVQVKLTGGRQVTGTLKGYDQLLNLVLDEAVEFLRDPDDPLKTTDQTRNLGLIVCRGTAVMLVSPTDGTDEIANPFIQPDGS

SEQ ID NO: 16153 - DNA, 300 bp, Glycine max
  CDS (1)..(300)
atgtcaggcagaaaagaaacggttttggaccttgcaaagtttgtagacaaaggcgttcaagttaagcttactggtggaagacaagtgacagggactctgaaagggtatgatcaattgcttaaccttgtcctagatgaagctgtagagtttttaagagatcctgatgatcctctcaaaactactgaccagaccagaaatcttggcttaattgtttgtagaggaactgctgtgatgcttgtgtccccaactgatggtacagatgagatcgccaacccctttatgcagccagatgggtcctaa

SEQ ID NO: 16154 - protein, 99 aa, Glycine max
MSGRKETVLDLAKFVDKGVQVKLTGGRQVTGTLKGYDQLLNLVLDEAVEFLRDPDDPLKTTDQTRNLGLIVCRGTAVMLVSPTDGTDEIANPFMQPDGS

SEQ ID NO: 16155 - DNA, 240 bp, Glycine max
  CDS (1)..(240)
atgagcaggtcaggccaaccaccggatttgaagaagtacatggacaagaagcttcagattaaactgaatggaaatcgcatgattgttggcactctccgtggctttgaccagtttatgaatttagttgttgacaacactgtggaagtgaatggcaatgagaaaaatgacatagggatggtggtaatcagaggaaatagtgtggtcactgttgaggcgcttgaacccgtgaacagggcctga

SEQ ID NO: 16156 - protein, 79 aa, Glycine max
MSRSGQPPDLKKYMDKKLQIKLNGNRMIVGTLRGFDQFMNLVVDNTVEVNGNEKNDIGMVVIRGNSVVTVEALEPVNRA

SEQ ID NO: 16157 - DNA, 240 bp, Glycine max
  CDS (1)..(240)
atgagcagatcagggcaaccaccggatttgaagaagtacatggacaagaagcttcagatcaagctgaatgcaaatcgcatggttgttggtactctccgtggcttcgaccagtttatgaatttagttgttgacaacactgtggaagtgaatggcaatgagaaaaatgacatagggatggtggtaatcagaggaaatagtgtggtcactgttgaggcgcttgaacctgtgaacaggacttga

SEQ ID NO: 16158 - protein, 79 aa, Glycine max
MSRSGQPPDLKKYMDKKLQIKLNANRMVVGTLRGFDQFMNLVVDNTVEVNGNEKNDIGMVVIRGNSVVTVEALEPVNRT

SEQ ID NO: 16159 - DNA, 294 bp, Glycine max
  CDS (1)..(294)
atggctacagaggaagagagtgcggtgaaggagcctttggatctcattaggctcagcctcgacgagcgtatctatgtcaaactccgttccgacagagagcttcgtggcaaacttcacgcttatgatcagcatcttaatatgattcttggtgatgttgaagaaattgttactacagtggaaatcgatgatgagacatacgaagaaattgtgaggactacaaagcggacagttcctttcctgtttgtcaggggagatggggtgatattggtttccccgccattgaggactgcatga

SEQ ID NO: 16160 - protein, 97 aa, Glycine max
MATEEESAVKEPLDLIRLSLDERIYVKLRSDRELRGKLHAYDQHLNMILGDVEEIVTTVEIDDETYEEIVRTTKRTVPFLFVRGDGVILVSPPLRTA

SEQ ID NO: 16161 - DNA, 357 bp, Bombyx mori
  CDS (1)..(357)
atggcatccaaagaaggaggtgaaaagtcaaaaggcagccaagtaacaggagataataaagaaaagagaaggaaagaatctatattagatcttagcaaatacttggagaaaagcatccgtgtaaaattcgcaggagggcgtgaagcggcgggaattcttaaaggctatgatccccttctaaaccttgtgctagacaatactacggagtttctaagagatcctgatgacccatacaaacttttggatgacacaagagctttaggtcttgttgtttgccgaggtacatcagttgttttaatatgtccaatggatggtatggaagcaataccaaacccatttattaaccaggaaggataa

SEQ ID NO: 16162 - protein, 118 aa, Bombyx mori
MASKEGGEKSKGSQVTGDNKEKRRKESILDLSKYLEKSIRVKFAGGREAAGILKGYDPLLNLVLDNTTEFLRDPDDPYKLLDDTRALGLVVCRGTSVVLICPMDGMEAIPNPFINQEG

SEQ ID NO: 16163 - DNA, 231 bp, Bombyx mori
  CDS (1)..(231)
atgtcaaaagcacatccaccagaattgaaaaaattcatggacaaaaaatggtcaataaagctgaatgcgggtcgcgctgttaccggtgtgttgcgcggttttgatccattcatgaatttagttcttgatgaatcagtcgaggagtgtaaagacggtcagcgtaacaatgttgggatggtggtaattcgtggtaacagtattataatgctggaatctttagacagactttag

SEQ ID NO: 16164 - protein, 76 aa, Bombyx mori
MSKAHPPELKKFMDKKWSIKLNAGRAVTGVLRGFDPFMNLVLDESVEECKDGQRNNVGMVVIRGNSIIMLESLDRL

SEQ ID NO: 16165 - DNA, 240 bp, Arabidopsis thaliana
  CDS (1)..(240)
atgagtcgatcaggtcagcctccagatctcaagaagtacatggacaagaaactccaaattaagcttaatgccaacagaatggttgttggaactctccgtggctttgatcagttcatgaatcttgttgtggataacactgttgaagtcaatggtgatgacaaaactgacattgggatggtggtgataagaggaaacagcattgttactgttgaagctctcgaaccagttggaagatcttag

SEQ ID NO: 16166 - protein, 79 aa, Arabidopsis thaliana
MSRSGQPPDLKKYMDKKLQIKLNANRMVVGTLRGFDQFMNLVVDNTVEVNGDDKTDIGMVVIRGNSIVTVEALEPVGRS

SEQ ID NO: 16167 - DNA, 240 bp, Sulfolobus solfataricus P2
  CDS (1)..(240): transl_table=11
gtgaattttttggcagaaacagcgcataaggtgttagcagagtcattaaacaacttagtattagtcaaactaaagggaaataaggaagtaagaggtatgttaaggagctatgatcaacatatgaatttagtcctatcagactcagaagagatacaaagtgatggtagtggtaaaaaattagggactatagtaataagaggagataatgtaattttaatttctcctctacaaacttcttag

SEQ ID NO: 16168 - protein, 79 aa, Sulfolobus solfataricus P2
MNFLAETAHKVLAESLNNLVLVKLKGNKEVRGMLRSYDQHMNLVLSDSEEIQSDGSGKKLGTIVIRGDNVILISPLQTS

SEQ ID NO: 16169 - DNA, 240 bp, Sulfolobus tokodaii str. 7
  CDS (1)..(240): transl_table=11
atgggtgttaatttggctgaaacagcacacaaggttctcgcagaatctttgggttctaccgtattagtgaaattaaaaggagataaaattgttagaggtactcttaagagttatgatatgcatatgaacttagtattagagaattctgaggaagtaatgagtgatggtagcactaggaaagtaggtacaataatcataagaggagataatgtaatattagtgtcaccaatgagtccttag

SEQ ID NO: 16170 - protein, 79 aa, Sulfolobus tokodaii str. 7
MGVNLAETAHKVLAESLGSTVLVKLKGDKIVRGTLKSYDMHMNLVLENSEEVMSDGSTRKVGTIIIRGDNVILVSPMSP

SEQ ID NO: 16171 - DNA, 333 bp, Drosophila melanogaster
  CDS (1)..(333)
atggcagataaaaaggtgggtggcaacaatgacggtaaggagaagcgccgcaaggagtccattctggacctctccaagtacttggagaaacagatccgcgtgaaattcgcgggcggccgcgaggcatccggaatcctcaagggctacgatgcgctgctcaatctggtgctggacaacacggtggagtatctgcgcgactcggatgagccctacaaactgaccgaggagcagacccgcagcctgggactggtcgtctgtcgcggcacagccctcgtcctcatttgtccgcaagacggagtcgagagcatcgccaatccgtttataacgcaatag

SEQ ID NO: 16172 - protein, 110 aa, Drosophila melanogaster
MADKKVGGNNDGKEKRRKESILDLSKYLEKQIRVKFAGGREASGILKGYDALLNLVLDNTVEYLRDSDEPYKLTEEQTRSLGLVVCRGTALVLICPQDGVESIANPFITQ

SEQ ID NO: 16173 - DNA, 300 bp, Arabidopsis thaliana
  CDS (1)..(300)
atgtctggaagaaaagaaacggttttagatttggccaagtttgtagataagggtgtgcaagttaagctcactggtggtagacaagtgactggaactcttaaaggctatgaccaattgcttaatcttgttcttgatgaagcagtcgagttcgttcgagatcatgatgatcctttgaagactacggatcagacaagacgccttggtttgattgtttgccgtggaacagcggtgatgcttgtctcaccaaccgatggcaccgaagaaatcgctaacccgttcgttactgcagaggctgtctaa

SEQ ID NO: 16174 - protein, 99 aa, Arabidopsis thaliana
MSGRKETVLDLAKFVDKGVQVKLTGGRQVTGTLKGYDQLLNLVLDEAVEFVRDHDDPLKTTDQTRRLGLIVCRGTAVMLVSPTDGTEEIANPFVTAEAV

SEQ ID NO: 16175 - DNA, 372 bp, Apis mellifera
  CDS (1)..(372)
atgtctgtaagtataaataatattattcccgacactaaaactttgtctcagcagaatgcacacggagaaccgaaagaaagaaagaagaaagagagtatacttgatctgtcgaaatatttagagaaaaatattagagtaaagttcgccggtgggagggaagcagcaggaatcttaaaagggtacgacccccttctcaacttggtacttgataacactacagaatacctcagagatcctgatgatccatacaaattgaatcaagatactcgtatgttgggtttagtcgtatgcagaggtacatctgtggtacttatttgtcccgtagatgggatggaatcaattcaaaatccttttatacaacaagaaggttaa

SEQ ID NO: 16176 - protein, 123 aa, Apis mellifera
MSVSINNIIPDTKTLSQQNAHGEPKERKKKESILDLSKYLEKNIRVKFAGGREAAGILKGYDPLLNLVLDNTTEYLRDPDDPYKLNQDTRMLGLVVCRGTSVVLICPVDGMESIQNPFIQQEG

SEQ ID NO: 16177 - DNA, 348 bp, Nasonia vitripennis
  CDS (1)..(348)
atgtctgggaacaagccccaagcgcagcagcaaaatgcttccgatcagaaggagaagaagaggaaagagagtattctcgacttgtcgaaatacttggagaagaatatcagagtcaagttcgcagggggcagggaagcctcagggattttgaaaggatacgatccactgctaaatcttgtgttggataacacaactgaatacctacgagatcccgatgacccatacaagttgaatcaggacactagaatgctggggctagtggtctgtcgaggaacctctgttgtacttatatgtccagttgatggcatggaatccattccaaatccatttgtacagcaagaaggatga

SEQ ID NO: 16178 - protein, 115 aa, Nasonia vitripennis
MSGNKPQAQQQNASDQKEKKRKESILDLSKYLEKNIRVKFAGGREASGILKGYDPLLNLVLDNTTEYLRDPDDPYKLNQDTRMLGLVVCRGTSVVLICPVDGMESIPNPFVQQEG

SEQ ID NO: 16179 - DNA, 384 bp, Aedes aegypti
  CDS (1)..(384)
atggcagataaaaagtccggcccgagcggtcctggtggccctgaacgtggtggtccaggaggaggaggcggtggcggtggcgacaacaaggaaaagcgccgcaaggaatcgatccttgatctgagcaaatacctggagaaaaccatacgggtcaagttttccggcgggcgggaagcggccggcgttttgaaaggatatgatccgctgctcaatttggtactggacaacacggtggaattcctgcgcgatccggacgactacaagctggcggaagaaacgagacatttgggactggtggtttgccgggggacatcggtggtgttgatttgtccccaggagggcatggagtccatccagaatccgttcatcacgcaggaaggttaa

SEQ ID NO: 16180 - protein, 127 aa, Aedes aegypti
MADKKSGPSGPGGPERGGPGGGGGGGGDNKEKRRKESILDLSKYLEKTIRVKFSGGREAAGVLKGYDPLLNLVLDNTVEFLRDPDDYKLAEETRHLGLVVCRGTSVVLICPQEGMESIQNPFITQEG

SEQ ID NO: 16181 - DNA, 330 bp, Chlamydomonas reinhardtii
  CDS (1)..(330)
atggcaggaaaggccaaggagtcggcggtcgacctcgccaagtttattgacaagggcgttcgcgtcaagcttgctggtggacgggaagtgcaagggatcttgaagggctacgaccagctgctgaacctggtgatcgatgaggctgtggagtacctccgagacccggaagacccgctcacggtgaccgatgagacccggtcactagggctgctggtgtgccgcggcactgcagtgatgctggttgcgccgtccgcgggcatggaggagattgccaaccccttcctccaggcgaaagacggcgagcaggcggcagagggcgacgatgaatag

SEQ ID NO: 16182 - protein, 109 aa, Chlamydomonas reinhardtii
MAGKAKESAVDLAKFIDKGVRVKLAGGREVQGILKGYDQLLNLVIDEAVEYLRDPEDPLTVTDETRSLGLLVCRGTAVMLVAPSAGMEEIANPFLQAKDGEQAAEGDDE

SEQ ID NO: 16183 - DNA, 309 bp, Physcomitrella patens subsp. patens
  CDS (1)..(309)
atgtcgggaagaaaagaaaccgtgctggatctggccaagtttgtggatagaggagtatctgtgaagctgagtggtggccgacaagtgacaggaactttaaaaggatatgatcagcttttgaatttggtgctggacgaggctacggaaaacttgagggattcggatgatcctttgaagacgacagatcaaatgagacaattaggcttgattgtttgtagaggaactgctgtaatgctggttgctccaacagacggtactgaggaaattgcaaatccgtttcttgcgaatgagactcctgctgctacttga

SEQ ID NO: 16184 - protein, 102 aa, Physcomitrella patens subsp. patens
MSGRKETVLDLAKFVDRGVSVKLSGGRQVTGTLKGYDQLLNLVLDEATENLRDSDDPLKTTDQMRQLGLIVCRGTAVMLVAPTDGTEEIANPFLANETPAAT

SEQ ID NO: 16185 - DNA, 309 bp, Physcomitrella patens subsp. patens
  CDS (1)..(309)
atgtcaggaaggaaagagactgtgctggatctggccaagtttgtggataggggagtgtcggtgaagctgagtggtggtcgacaagtgacaggaattttgaaaggatatgaccaacttttgaatttggtgcttgacgaggccacggaaaacttgagagactcggacgatcctatgaagaccacggaccaaataagacaattgggcttgattgtctgcagaggaactgctgtcatgttggttgccccaacagatggtactgaggagataccaaatccgtttcttcaaaacgagacccccgccgctacttga

SEQ ID NO: 16186 - protein, 102 aa, Physcomitrella patens subsp. patens
MSGRKETVLDLAKFVDRGVSVKLSGGRQVTGILKGYDQLLNLVLDEATENLRDSDDPMKTTDQIRQLGLIVCRGTAVMLVAPTDGTEEIPNPFLQNETPAAT

SEQ ID NO: 16187 - DNA, 231 bp, Physcomitrella patens subsp. patens
  CDS (1)..(231)
atgagcaagtcgggtcaacctccagacctgaagaagtacatggacaggaaactgaacatcaagctcaatgctggcaggaacgtcgttggagttctgcgcgggtttgaccaattcatgaacctcgtgctggacaacaccgttgaagttcaaggtgctgagaaaaatgaaatcggcatggtggttatacgagggaacagtgttgtcatgatcgaagctcttgaagttgtgtag

SEQ ID NO: 16188 - protein, 76 aa, Physcomitrella patens subsp. patens
MSKSGQPPDLKKYMDRKLNIKLNAGRNVVGVLRGFDQFMNLVLDNTVEVQGAEKNEIGMVVIRGNSVVMIEALEVV

SEQ ID NO: 16189 - DNA, 234 bp, Physcomitrella patens subsp. patens
  CDS (1)..(234)
atgagcaaatcagggcaacccccggatttgaagaagtacatggacaagaagctgaacatcaagctcaatgctggtaggaatgttgttggagtcctgcgtggatttgaccagttcatgaaccttgtactggataacactgttgagatcaatggtgctgacagaaacgagattggcatggtggttattcgtgggaacagcgtagtcatgatcgaggcactagaagctgtaagatag

SEQ ID NO: 16190 - protein, 77 aa, Physcomitrella patens subsp. patens
MSKSGQPPDLKKYMDKKLNIKLNAGRNVVGVLRGFDQFMNLVLDNTVEINGADRNEIGMVVIRGNSVVMIEALEAVR

SEQ ID NO: 16191 - DNA, 378 bp, Coprinopsis cinerea okayama7#130
  CDS (1)..(378)
atggcagatcgcggccgtgctccagctcgtggtgcgcctcgcggtggaacccccatgaggggaggcaggccagcaccgtcctcatcaggcccaccagccgacaaacccaaacgcgaggccatcctcgacctctcaaagtatgtcaacgaaaagatcagagtcaaattcactggcggacgcgaagtgatcggcgtcctgaaaggctatgaccagctgctgaaccttgtactagacgaggtcgaggaggaagtctcagcatccaacccttacaagaaacgctcactcggcctcgtcgtcctgcgcggcccgaccatcacactcctcagccccgtagacggctttgaagagatcgccaaccccttcgtcagcgaagagtag

SEQ ID NO: 16192 - protein, 125 aa, Coprinopsis cinerea okayama7#130
MADRGRAPARGAPRGGTPMRGGRPAPSSSGPPADKPKREAILDLSKYVNEKIRVKFTGGREVIGVLKGYDQLLNLVLDEVEEEVSASNPYKKRSLGLVVLRGPTITLLSPVDGFEEIANPFVSEE

SEQ ID NO: 16193 - DNA, 393 bp, Culex quinquefasciatus
  CDS (1)..(393)
atggccgataacaaaaagtccggtcccggtgggggccccggcggagaccgcggtggtgatcggggaggtggttccgggggcggcggtggcgacaacaaggaaaaacgccgcaaggaatccatcctggacctgagcaagtacctggaaaaaacgatccgggtcaagtttgccggcgggcgggaagccgcgggtgtcctcaaggggtacgatccgctgctcaacctggtgctggacaacacggtcgagttcctgcgtgacccggacgattacaagctggcggaggaatcgcgacatctcgggctcgtcgtgtgccgggggacatccgtggtgttgatctgtccgcaggagggcatggaatcgatacagaatccgttcatcacacaggaaggttag

SEQ ID NO: 16194 - protein, 130 aa, Culex quinquefasciatus
MADNKKSGPGGGPGGDRGGDRGGGSGGGGGDNKEKRRKESILDLSKYLEKTIRVKFAGGREAAGVLKGYDPLLNLVLDNTVEFLRDPDDYKLAEESRHLGLVVCRGTSVVLICPQEGMESIQNPFITQEG

SEQ ID NO: 16195 - DNA, 381 bp, Anopheles gambiae str. PEST
  CDS (1)..(381)
atgtcggataagaagccagcggcatccggcaattcgactggtggtggtggaagtggtggtggtggcggcggcggaggcgacaataaagaaaagcgacgaaaggaatccatcctcgatctgagcaaatatctggagaagacgatacgggtcaagtttgccggtggacgggaagcggccggcgtgctgaagggttacgatccgctgctgaacctggtgctggacaatacgatagagtttttgcgcgatccggacgattacaagctggcggacgatacgcggcacctgggactggtggtgtgccggggcacgtcggtggtgttgatctgcccgcaggatggcatggaatcgatacagaaccccttcatcgcccaggaaggctag

SEQ ID NO: 16196 - protein, 126 aa, Anopheles gambiae str. PEST
MSDKKPAASGNSTGGGGSGGGGGGGGDNKEKRRKESILDLSKYLEKTIRVKFAGGREAAGVLKGYDPLLNLVLDNTIEFLRDPDDYKLADDTRHLGLVVCRGTSVVLICPQDGMESIQNPFIAQEG

SEQ ID NO: 16197 - DNA, 441 bp, Magnaporthe grisea 70-15
  CDS (1)..(441)
atggccgaccggccacaccgaggcggaggcggcggcggcggcaaccggggcaactaccgaggacgcggcggaggtgaccgtggcggtcgaggcggccgaggcggcgatcaccaccacggtggcaagaacaacgaccagcagggcgagcgcgagcggccaaagaaggagaacatcctggacctggcgaaatacatggataaggaggtgcaggtcaagttcaacggcggacgcgaagtcattggaactctaaagggctacgatgcgctcatgaacctggtgctggatgaggtcaaggagaccatgagagacgaagaaggaaacgagtctagccggcccctgggcctcgtcgtcgttcgcggcaccctcctggtcgccatcagccccacggacggctccgagtctattgcaaacccgtttttgcagcagggggatgacgagtga

SEQ ID NO: 16198 - protein, 146 aa, Magnaporthe grisea 70-15
MADRPHRGGGGGGGNRGNYRGRGGGDRGGRGGRGGDHHHGGKNNDQQGERERPKKENILDLAKYMDKEVQVKFNGGREVIGTLKGYDALMNLVLDEVKETMRDEEGNESSRPLGLVVVRGTLLVAISPTDGSESIANPFLQQGDDE

SEQ ID NO: 16199 - DNA, 396 bp, Gibberella zeae PH-1
  CDS (1)..(396)
atgtccgatagaccatcacaccgaggtggccgcggccaaggatcacatcctcgaggtggacgcggaggcggtcgcggaggaggcgcgggaggcgctcagcaggagcgcgagagacccaagaaggagaacatccttgacctgggcaagtacatggacaagcagatcaccgtcaagtttaacggtggccgtgaggtcaagggcacgctgaagggctatgacgctctgatgaacctggttctggatgatgtgcatgaggttgttcgagacgacgaaggcaacgagtctactcgatccctcggtcttgtggttgtacgaggcaccctccttgttcttgtcagccccgtcgacggcagtgaagaaattgccaacccttttgttcaacccgaggatgactga

SEQ ID NO: 16200 - protein, 131 aa, Gibberella zeae PH-1
MSDRPSHRGGRGQGSHPRGGRGGGRGGGAGGAQQERERPKKENILDLGKYMDKQITVKFNGGREVKGTLKGYDALMNLVLDDVHEVVRDDEGNESTRSLGLVVVRGTLLVLVSPVDGSEEIANPFVQPEDD

SEQ ID NO: 16201 - DNA, 354 bp, Candida glabrata CBS 138
  CDS (1)..(354)
atgagcgaacagaatactcaacaagcggaacagaataacaacaacagagggcagcaaaagaagaagtttgaagctccaaagagagaggccattgtagatctaggtaaatataaagacagcaaggtttcagtcaaactgatgggtggtagaatagtgacaggcattctaaagggttacgatcagttgatgaatctcgtgcttgaagaaacagaagagacattgaaaccagaagtcgaaacaggtgctacccagcaagttacaaggcaattgggtctaactgtcataagaggaactattttaatatccttgagcccactggatggctctgaggtgctttacattcaaactaactaa

SEQ ID NO: 16202 - protein, 117 aa, Candida glabrata CBS 138
MSEQNTQQAEQNNNNRGQQKKKFEAPKREAIVDLGKYKDSKVSVKLMGGRIVTGILKGYDQLMNLVLEETEETLKPEVETGATQQVTRQLGLTVIRGTILISLSPLDGSEVLYIQTN

SEQ ID NO: 16203 - DNA, 333 bp, Kluyveromyces lactis NRRL Y-1140
  CDS (1)..(333)
atgagcgaagcaaggcaatcacaacaaccgagacaagagcagaagaagaagttcgaaggcccaaagcgtgagtctatcataaatcttgcacaatataaggacacagaagtacgtgtcaagttcatagggggaagactggtcactggaatcctaaagggttatgacgagctaatgaacttggttcttgacgaaaccgtcgaatatgcaagagacccagaagatgaaaccatcatccacaaggaccaagccaaaaaaattggtttggtcgtcataagaggaacagctctactttcgctatgttccctcgaaggtgctgagatcatcaatacctag

SEQ ID NO: 16204 - protein, 110 aa, Kluyveromyces lactis NRRL Y-1140
MSEARQSQQPRQEQKKKFEGPKRESIINLAQYKDTEVRVKFIGGRLVTGILKGYDELMNLVLDETVEYARDPEDETIIHKDQAKKIGLVVIRGTALLSLCSLEGAEIINT

SEQ ID NO: 16205 - DNA, 411 bp, Aspergillus nidulans FGSC A4
  CDS (1)..(411)
atgtccgaacgaggctcgttccgtggaggtggccgcaaccgcggcggaggttatgatcgatctggcggccgtggcggacatggaaaaagtggcggtgccggtggcggtgctcaacagcaacagcaggagaagcccaaaaaggaaaacattctcgacttgaccaagtacatggacaaggaggtccgggtcaagtttaacggtggccgagaagtttctggaatactcaagggctacgatcagcttatgaaccttgttttggatgatgtgaaagagtcgatgcgtgacgacgagggcaacgagaccacacgggctctcggtcttattgtcgcccgtggcactttgatcgtgctgatctctcccgccgatggtagcgaacagatcgccaacccattcgtacaggcagaggagtag

SEQ ID NO: 16206 - protein, 136 aa, Aspergillus nidulans FGSC A4
MSERGSFRGGGRNRGGGYDRSGGRGGHGKSGGAGGGAQQQQQEKPKKENILDLTKYMDKEVRVKFNGGREVSGILKGYDQLMNLVLDDVKESMRDDEGNETTRALGLIVARGTLIVLISPADGSEQIANPFVQAEE

SEQ ID NO: 16207 - DNA, 528 bp, Ustilago maydis 521
  CDS (1)..(528)
atggccatgtcgctgattgtctttcgcttggtactcgctcttgcttttgctttttcttttcttcttggacgatgtgcgaaaccgccactgttacagggtcgtggtggacgaggcggcaacttctccggatcttcgcatcggggcggtggctcggctcgcggcaactcttcccgtggaggctcttctcgtggcgcatctcgcggtggcgcccacaactcggcttcctcctctgcaccttcagaacgacccaagaaagaagccatcctcgatctatccaagtacatggaccagaagatccgcgtcaagttcgccggaggccgcgaagtgttcggcacgctcaaaggttttgatcaactgatgaatctcgtcatggacgaagtgaccgagtccgtgcgcgacgaagaaggcaatgtgacggacaagacgaggaatctgggcctcgtggtgttgaggggtaccgcgctgacggttatcaatccagcggatgggtttgaaagcatcgaaaatccgttcgctcaggcagagtaa

SEQ ID NO: 16208 - protein, 175 aa, Ustilago maydis 521
MAMSLIVFRLVLALAFAFSFLLGRCAKPPLLQGRGGRGGNFSGSSHRGGGSARGNSSRGGSSRGASRGGAHNSASSSAPSERPKKEAILDLSKYMDQKIRVKFAGGREVFGTLKGFDQLMNLVMDEVTESVRDEEGNVTDKTRNLGLVVLRGTALTVINPADGFESIENPFAQAE

SEQ ID NO: 16209 - DNA, 396 bp, Cryptococcus neoformans var. neoformans B-3501A
  CDS (1)..(396)
atgtcttcaagaggtggccgaggcggagctcgtggtggtggtaaccaaggaggtgaacgcaagaagcgagaatcaattctcaacttggctcagtttgtcgacaagagtatcagagttaaatttatgggtggacgagaagctactggtatcttgaaaggctatgaccaacttatgaacttggtcatggatgatgtagttgaggagtatgaggatggccgacctacacgaagtcttggattagtcgttctccgtggccccaatattgtccttgttagcccaacggacggatcatcaggcaagtcgtttcttaaatccatccgaaacggccaaagcaaaagtgttaacatgcgacaatcatttagaaatcgaaaaccctttccaacagtaataatgtag

SEQ ID NO: 16210 - protein, 131 aa, Cryptococcus neoformans var. neoformans B-3501A
MSSRGGRGGARGGGNQGGERKKRESILNLAQFVDKSIRVKFMGGREATGILKGYDQLMNLVMDDVVEEYEDGRPTRSLGLVVLRGPNIVLVSPTDGSSGKSFLKSIRNGQSKSVNMRQSFRNRKPFPTVIM

SEQ ID NO: 16211 - DNA, 327 bp, Strongylocentrotus purpuratus
  CDS (1)..(327)
atgagtcaattcgccagtcaacaggagcagcagaagaaaaagaaggagagtatcttagatttgtcaaaatatattgacaagcaaatacgtgtcaaattccaaggaggcagagaagtgaccggggtcctgaagggatttgatcctctcctgaatttggtactggatggaacaacagagtttatgcgagatccagatgacccattcaagctcactgatgatacgaggaaccttggtcttgcagtatgtagaggaacatcggtggtcctgatatgtcctgcggagggaatggagcctatagctaacccttttgttcaacaagacgggtga

SEQ ID NO: 16212 - protein, 108 aa, Strongylocentrotus purpuratus
MSQFASQQEQQKKKKESILDLSKYIDKQIRVKFQGGREVTGVLKGFDPLLNLVLDGTTEFMRDPDDPFKLTDDTRNLGLAVCRGTSVVLICPAEGMEPIANPFVQQDG

SEQ ID NO: 16213 - DNA, 231 bp, Tribolium castaneum
  CDS (1)..(231)
atgtcgaaagcacatcctccggaattgaaaaaatttatggacaaaaaattgtgtttgaagttgaatgggggccggcaagtcgttggtattttgcgcggtttcgacccttttatgaacctggtggtggacgagagcgtggaagaatgccgggatggcaagaaaaacaatatcgggatggtggtgatccggggaaacagtatcgtcatgttggaggctctagataggatttag

SEQ ID NO: 16214 - protein, 76 aa, Tribolium castaneum
MSKAHPPELKKFMDKKLCLKLNGGRQVVGILRGFDPFMNLVVDESVEECRDGKKNNIGMVVIRGNSIVMLEALDRI

SEQ ID NO: 16215 - DNA, 342 bp, Tribolium castaneum
  CDS (1)..(342)
atggcatcgtcaggtgacaaatcaaaaaatcagagcggtgaccaaaaagagaagaaacgtaaagagtcgattctagacctctctaaataccttgaaaagacaattagggtgaaatttgcgggcggccgagaagctagtggtattttaaaaggctatgacccccttttgaacctcgtcttagacaacacaatcgaatacttgagagatccagacgacccttataaattaacagaagacacgagggccttgggtttggtggtctgtaggggcacaagtgtcgtgctcatatgccccatggacggcatggagtccatacagaacccctttatatcccaagactaa

SEQ ID NO: 16216 - protein, 113 aa, Tribolium castaneum
MASSGDKSKNQSGDQKEKKRKESILDLSKYLEKTIRVKFAGGREASGILKGYDPLLNLVLDNTIEYLRDPDDPYKLTEDTRALGLVVCRGTSVVLICPMDGMESIQNPFISQD

SEQ ID NO: 16217 - DNA, 294 bp, Oryza sativa subsp
  CDS (1)..(294)
atgtcggggcgcaaggagacggtgctggacctggccaagttcgtcgacaagggcgtcccagtatcattttacggacagagtgttacagggactttgaagggctatgaccagcttctaaacttggtgcttgatgaagcggttgaatttgaaagagagcaagatgatccattgaaactatcagggaaaaccagacagcttggtcttattgtctgtaggggtacagcggtgatgcttgtatcgccaaccgatggaacggacgagattgccaaccccttccaatctgatggtgcataa

SEQ ID NO: 16218 - protein, 97 aa, Oryza sativa subsp
MSGRKETVLDLAKFVDKGVPVSFYGQSVTGTLKGYDQLLNLVLDEAVEFEREQDDPLKLSGKTRQLGLIVCRGTAVMLVSPTDGTDEIANPFQSDGA

SEQ ID NO: 16219 - DNA, 243 bp, Vitis vinifera
  CDS (1)..(243)
atgagcagatcaggccagcctccggatctcaagaaatacatggataagaagcttcaaatcaagttgaatgcaaaccggatggtggttggaactcttcgtgggtttgaccagttcatgaacctggtggtggacaacactgtggaagtgaatggaaatgagaaaactgatataggcatggtggttattagaggaaatagtgtggttactgttgaagctcttgagccagtaagccggatgcagtga

SEQ ID NO: 16220 - protein, 80 aa, Vitis vinifera
MSRSGQPPDLKKYMDKKLQIKLNANRMVVGTLRGFDQFMNLVVDNTVEVNGNEKTDIGMVVIRGNSVVTVEALEPVSRMQ

SEQ ID NO: 16221 - DNA, 342 bp, Vitis vinifera
  CDS (1)..(342)
atgttgatacagtatgatatgtggtgttatgaaactctgtttcagtcaggaaggaaagaaacagttttggatctggcgaagttcgtggacaagggtgttcaagttaagcttactggtggaagacaagtaacagggacgctaaaaggttatgatcagttgctaaaccttgtcttggatgaagctgtagagtttttaagagatccagatgatccacagaagactacagatcaaaccaggcgccttggcctaatagtttgtaggggaactgcagtaatgctggtgtcaccaactgatggcacagatgagattgctaacccttttatccagccagatggggcctag

SEQ ID NO: 16222 - protein, 113 aa, Vitis vinifera
MLIQYDMWCYETLFQSGRKETVLDLAKFVDKGVQVKLTGGRQVTGTLKGYDQLLNLVLDEAVEFLRDPDDPQKTTDQTRRLGLIVCRGTAVMLVSPTDGTDEIANPFIQPDGA

SEQ ID NO: 16223 - DNA, 243 bp, Picea sitchensis
  CDS (1)..(243)
atgagcaggtcagggcagcccccggatctcaagaagtacatggacaagaagcttaacataaagttgaacgccaacagagtggtggttggtactctacgaggatttgaccagttcatgaatttagtcctggatggtactgtagaagtaaatggcaatgaaagaaatgagataggcatggtggttatcagggggaacagtgttgtgatgattgaagctttggaaccggtcaacaggtcatcataa

SEQ ID NO: 16224 - protein, 80 aa, Picea sitchensis
MSRSGQPPDLKKYMDKKLNIKLNANRVVVGTLRGFDQFMNLVLDGTVEVNGNERNEIGMVVIRGNSVVMIEALEPVNRSS

SEQ ID NO: 16225 - DNA, 243 bp, Populus trichocarpa
  CDS (1)..(243)
atgagccgatcgggtcagccaccagatctcaagaagtatatggacaagaagcttcaaatcaagctgaatgcaaataggatggtggttggaacacttcgtgggtttgaccagttcatgaatttagttgttgacaacactgtggaggtgaatggtgatgagaaaactgatataggcatggtggtgctcagaggcaatagtgttgtcacagttgaagcattggaacctgtaaacagagcacagtga

SEQ ID NO: 16226 - protein, 80 aa, Populus trichocarpa
MSRSGQPPDLKKYMDKKLQIKLNANRMVVGTLRGFDQFMNLVVDNTVEVNGDEKTDIGMVVLRGNSVVTVEALEPVNRAQ

SEQ ID NO: 16227 - DNA, 300 bp, Populus trichocarpa
  CDS (1)..(300)
atgtcagggaggaaagaaacagtattggatttggctaagttcgtggacaagggtgttcaagtcaagctcactggtggtagacaagtgacagggactttgaagggatatgaccaattactaaaccttgtcctggatgaggcggtagaatttctaagagatgctgatgatccgctaaagaccactgatcagacaaggcgccttggcctaattgtttgcaggggaactgctgtgatgctggtgtctccaactgatggtacagatgagattgccaacccttttgtccagccagatggagcctag

SEQ ID NO: 16228 - protein, 99 aa, Populus trichocarpa
MSGRKETVLDLAKFVDKGVQVKLTGGRQVTGTLKGYDQLLNLVLDEAVEFLRDADDPLKTTDQTRRLGLIVCRGTAVMLVSPTDGTDEIANPFVQPDGA

SEQ ID NO: 16229 - DNA, 306 bp, Ostreococcus tauri
  CDS (1)..(306)
atgggcggcgtcgccatccccgagctcaagcaggaacagagcgacgcgcgaacctcgagactgacgtgtaaccgttccacactcaggtacatggacaaaaagctccgcctgcgattgaacggcaatcgaagcgtgaccgggatcctgagaggttttgatcagtttctcaacctggtcctggacgactcgacgaacgacacgacgacggagaagacgccgatgggaatggtcgtcgtgcgagggaattctgtggtgagcatggaggcgttagaatacatcgcaccggcggtgcgacggggggcgtga

SEQ ID NO: 16230 - protein, 101 aa, Ostreococcus tauri
MGGVAIPELKQEQSDARTSRLTCNRSTLRYMDKKLRLRLNGNRSVTGILRGFDQFLNLVLDDSTNDTTTEKTPMGMVVVRGNSVVSMEALEYIAPAVRRGA

SEQ ID NO: 16231 - DNA, 243 bp, Medicago truncatula
  CDS (1)..(243)
atgagtaggtcagggcagccaccagatttgaagaagtacatggacaaacagcttcaaatcaagctgaatgcaaatcgcatgattgttggtactctccgtggcttcgaccaatttatgaatttggttgttgacaatactgtggaggtgaatggcaatgagaaaaatgacatagggatggtggtgatcagaggaaatagtgtggtcactgtagaagcgcttgaaccagtgaacagaagcatctaa

SEQ ID NO: 16232 - protein, 80 aa, Medicago truncatula
MSRSGQPPDLKKYMDKQLQIKLNANRMIVGTLRGFDQFMNLVVDNTVEVNGNEKNDIGMVVIRGNSVVTVEALEPVNRSI

SEQ ID NO: 16233 - DNA, 231 bp, Lysiphlebus testaceipes
  CDS (1)..(231)
atgagtaaagcacatcctccagaattaaaaaaatatatggataaaaaattatcattaaaattaaatggaggaagacacgttattggtattcttcgtggttttgatccattcatgaacatggttattgatgaaagtgttgaagaatgcaaagatggttcacaaaataatattggaatggtggtaattcgaggtaacagcgttattatgttagaggcactggatcgaatatga

SEQ ID NO: 16234 - protein, 76 aa, Lysiphlebus testaceipes
MSKAHPPELKKYMDKKLSLKLNGGRHVIGILRGFDPFMNMVIDESVEECKDGSQNNIGMVVIRGNSVIMLEALDRI

SEQ ID NO: 16235 - DNA, 270 bp, Saccharomyces cerevisiae
  CDS (1)..(270)
atggagacacctttggatttattgaaactcaatctcgatgagagggtgtacatcaagctgcgcggggccaggacgctggtgggcacactgcaagcgttcgactcacactgcaacatcgtgctgagtgatgcagtagagaccatataccaattaaacaacgaggagttgagtgagtccgaaagacgatgtgaaatggtgttcatcagaggagacacagtgactctaatcagcacgccctctgaagatgacgatggcgcagtggagatataa

SEQ ID NO: 16236 - protein, 89 aa, Saccharomyces cerevisiae
METPLDLLKLNLDERVYIKLRGARTLVGTLQAFDSHCNIVLSDAVETIYQLNNEELSESERRCEMVFIRGDTVTLISTPSEDDDGAVEI

SEQ ID NO: 16237 - DNA, 342 bp, Schizosaccharomyces pombe
  CDS (1)..(342)
atgtccagtcttcaaaaacgccctggcccaggtaactctagtcaaccgactgaaagaccaagaaaagaatctatccttgatctttctagatatcaagatcaacgaattcaagccacgtttacggggggccgacaaattaccggtattctaaaaggattcgatcagttgatgaaccttgtacttgacgatgtagaggaacagcttcgcaatcctgaggatggtaaacttactggagctattagaaagttaggtcttgtagtcgttcgtggaacaactttagttttgattgctcccatggatggttctgaggagataccgaatccattcgtccaagctgaataa

SEQ ID NO: 16238 - protein, 113 aa, Schizosaccharomyces pombe
MSSLQKRPGPGNSSQPTERPRKESILDLSRYQDQRIQATFTGGRQITGILKGFDQLMNLVLDDVEEQLRNPEDGKLTGAIRKLGLVVVRGTTLVLIAPMDGSEEIPNPFVQAE

SEQ ID NO: 16239 - DNA, 243 bp, Arabidopsis thaliana
  CDS (1)..(243)
atgagtcgttcaggtcagcctccggatcttaagaagtacatggataagaagctccaaatcaagcttaatgctaaccgaatggttactggaactcttcgtgggtttgatcagttcatgaatcttgttgtggataacactgttgaggtgaacggtaacgacaaaaccgacatcgggatggtggtgattagaggaaacagcattgtcactgttgaagctcttgaaccagtgggcagatcttcttag

SEQ ID NO: 16240 - protein, 80 aa, Arabidopsis thaliana
MSRSGQPPDLKKYMDKKLQIKLNANRMVTGTLRGFDQFMNLVVDNTVEVNGNDKTDIGMVVIRGNSIVTVEALEPVGRSS

SEQ ID NO: 16241 - DNA, 231 bp, Drosophila melanogaster
  CDS (1)..(231)
atgtcgaaggcccatcccccagaggtgaaaaaatacatggacaagcgcatgatgctgaaactgaacggcggacgcgcggtgaccggtattttgcgaggcttcgatcccttcatgaacgtggtcctggacgacacggtggaggagtgcaaggacaacacgaagaacaacatcggcatggtggttatccgcggcaacagcatcgtcatggtggaggccctggacagggtctag

SEQ ID NO: 16242 - protein, 76 aa, Drosophila melanogaster
MSKAHPPEVKKYMDKRMMLKLNGGRAVTGILRGFDPFMNVVLDDTVEECKDNTKNNIGMVVIRGNSIVMVEALDRV

SEQ ID NO: 16243 - DNA, 234 bp, Saccharomyces cerevisiae
  CDS (1)..(234)
atggtttctacccctgaactgaagaaatatatggacaagaagatattgctgaatataaatggatctaggaaagtggcaggaattttgcgaggctacgatattttcttaaacgtcgttcttgatgatgcaatggagataaatggtgaagaccctgccaataaccaccagctaggcttgcagaccgtcattaggggcaactccataatatccctagaggctctagatgccatataa

SEQ ID NO: 16244 - protein, 77 aa, Saccharomyces cerevisiae
MVSTPELKKYMDKKILLNINGSRKVAGILRGYDIFLNVVLDDAMEINGEDPANNHQLGLQTVIRGNSIISLEALDAI

SEQ ID NO: 16245 - DNA, 234 bp, Aeropyrum pernix
  CDS (1)..(234): transl_table=11
gtgagcgggccgataactctgcccacgctgaggatgatgctggactatgtggacacgcccgtgctagtcaagcttaagagcgggctcaggataaagggtgtcctgaagacctatgatcagcaccttaacataatactcggcgatgcagaagagataggggagacctccatcaggaggctagggctgactctggtgaggggggatagcgtagtagtgataacccctgccgcttga

SEQ ID NO: 16246 - protein, 77 aa, Aeropyrum pernix
MSGPITLPTLRMMLDYVDTPVLVKLKSGLRIKGVLKTYDQHLNIILGDAEEIGETSIRRLGLTLVRGDSVVVITPAA

SEQ ID NO: 16247 - DNA, 315 bp, Oryza sativa
  CDS (1)..(315)
atggcggcggcggcggcggcagcggcggctgaggaggagatcgcggtgaaggagccgctggatctgatcaggctcagcctcgacgagcgcatctacgtcaagctcaggtccgaccgcgagctccgcggcaagctccatgcatacgatcaacatttaaacatgattcttggagatgttgaggagatcgtgacaacagttgagattgacgatgagacatatgaagaaattgtgcgcaccacaaaacgcactatccccttcctttttgttcgaggtgatggtgtcattttggtttctccacccctccgaacggcatga

SEQ ID NO: 16248 - protein, 104 aa, Oryza sativa
MAAAAAAAAAEEEIAVKEPLDLIRLSLDERIYVKLRSDRELRGKLHAYDQHLNMILGDVEEIVTTVEIDDETYEEIVRTTKRTIPFLFVRGDGVILVSPPLRTA

SEQ ID NO: 16249 - DNA, 243 bp, Oryza sativa
  CDS (1)..(243)
atgagccgatcggggcagcccccggatctcaagaagtacatggacaagaagctccagatcaagctgaatgcaaaccgtgtaattgttggtacgctccgtggattcgatcagtttatgaatttggtggtggacaacacggtagaggtcaatggaaatgacaagactgatattggaatggtggttgtcagggggaacagtgttgtgatgattgaggcattggagccagtgcccaaatcccagtga

SEQ ID NO: 16250 - protein, 80 aa, Oryza sativa
MSRSGQPPDLKKYMDKKLQIKLNANRVIVGTLRGFDQFMNLVVDNTVEVNGNDKTDIGMVVVRGNSVVMIEALEPVPKSQ

SEQ ID NO: 16251 - DNA, 243 bp, Oryza sativa
  CDS (1)..(243)
atgagccgatcggggcagcctccggatctgaagaagtacatggacaagaagctccaaatcaagctgaatgcgaaccgtgttgtcattggcactcttcgaggattcgatcagtttatgaatttggtcgtggacaacacagtggaggtcaatggaaacgagaagaatgacatagggatggtggttatcaggggaaacagtgttgtgatgattgaagccctcgaacctgttcccaagccgcagtga

SEQ ID NO: 16252 - protein, 80 aa, Oryza sativa
MSRSGQPPDLKKYMDKKLQIKLNANRVVIGTLRGFDQFMNLVVDNTVEVNGNEKNDIGMVVIRGNSVVMIEALEPVPKPQ

SEQ ID NO: 16253 - DNA, 297 bp, Oryza sativa
  CDS (1)..(297)
atgtcggggcgcaaggagacggtgctggacctggccaagttcgtcgacaagggcgtccaggtcaagctcaccggcggcaggcaagttacagggactttgaagggctatgaccagcttctaaacttggtgcttgatgaagcggttgaatttgaaagagagcaagatgatccattgaaactatcagggaaaaccagacagcttggtcttattgtctgtaggggtacagcggtgatgcttgtatcgccaaccgatggaacggacgagattgccaaccccttccaatctgatggtgcataa

SEQ ID NO: 16254 - protein, 98 aa, Oryza sativa
MSGRKETVLDLAKFVDKGVQVKLTGGRQVTGTLKGYDQLLNLVLDEAVEFEREQDDPLKLSGKTRQLGLIVCRGTAVMLVSPTDGTDEIANPFQSDGA

SEQ ID NO: 16255 - DNA, 448 bp, Zea mays
  CDS (105)..(347)
gctgtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttgcatttgtaattgaagtctgtcgcttt

SEQ ID NO: 16256 - protein, 80 aa, Zea mays
MSRSGQPPDLKKYMDKKLQIKLNANRVVIGTLRGFDQFMNLVIDNTVEVNGNDKTDIGMVVIRGNSVVMIEALEPVAKSQ

SEQ ID NO: 16257 - DNA, 240 bp, Brassica napus
  CDS (1)..(240)
atgagtcgatcaggccagcctccggatctcaagaagtacatggacaagaaactccaaattaagcttaatgcaaacagaacggtagttggaactctccgtgggtttgaccagttcatgaatcttgtcgtcgataacaccgttgaagttaatggtgatgacaaaactgacattggcatggtggtgataagaggaaacagcattgtcactgttgaagctcttgaaccagttggaagatcttag

SEQ ID NO: 16258 - protein, 79 aa, Brassica napus
MSRSGQPPDLKKYMDKKLQIKLNANRTVVGTLRGFDQFMNLVVDNTVEVNGDDKTDIGMVVIRGNSIVTVEALEPVGRS

SEQ ID NO: 16259 - DNA, 243 bp, Brassica napus
  CDS (1)..(243)
atgagtcggtcaggtcagcctccggatctcaagaagtacatggacaagaaactccaaatcaagcttaatgctaacagaatggttgttggaactctccgtgggtttgatcagttcatgaatcttgttgttgacaacactgttgaggtgaacggtgatgacaaaaccgacattggaatggtggtgataagaggaaacagcattgtcaccgtggaagctcttgaaccagtgggcagatcttcttag

SEQ ID NO: 16260 - protein, 80 aa, Brassica napus
MSRSGQPPDLKKYMDKKLQIKLNANRMVVGTLRGFDQFMNLVVDNTVEVNGDDKTDIGMVVIRGNSIVTVEALEPVGRSS

SEQ ID NO: 16261 - DNA, 243 bp, Linum usitatissimum
  CDS (1)..(243)
atgagcagatccggtcagcctccggatttgaagaagtacatggataagaaacttcaaatcaagctgaacgcgaacagaatggtggtcggaacactccgtggctttgaccagttcatgaacttggtcatcgacaacaccgtggaagtgaacggtgaagacaaaactgaaatagggatggtggtgataagaggaaatagcgtggtgactgtggaagctctggagcctgtaaacagagggatataa

SEQ ID NO: 16262 - protein, 80 aa, Linum usitatissimum
MSRSGQPPDLKKYMDKKLQIKLNANRMVVGTLRGFDQFMNLVIDNTVEVNGEDKTEIGMVVIRGNSVVTVEALEPVNRGI

SEQ ID NO: 16263 - DNA, 243 bp, Linum usitatissimum
  CDS (1)..(243)
atgagcagatccggtcagcctccggatttgaagaagtacatggataagaaacttcaaatcaagctgaatgcgaacagaatggtggtcggaactctccgtgggtttgaccagttcatgaacttggttatcgacaacactgtggaagtgaatggtgaagacaaaactgacatagggatggtggtgataagaggaaatagcgttgtgactgtggaagctctggagcctgtaaacagagggatataa

SEQ ID NO: 16264 - protein, 80 aa, Linum usitatissimum
MSRSGQPPDLKKYMDKKLQIKLNANRMVVGTLRGFDQFMNLVIDNTVEVNGEDKTDIGMVVIRGNSVVTVEALEPVNRGI

SEQ ID NO: 16265 - DNA, 243 bp, Linum usitatissimum
  CDS (1)..(243)
atgagcagatccggtcagcctccggatttgaagaagtacatggataagaagcttcagatcaagctgaacgcgaacagaatggtggtcggaacactgcgtggctttgaccagttcatgaacttggtcatcgacaacaccgtggaggtgaacggtgaagagaaaactgaaatagggatggtggtgataagaggaaatagcgtggtgactgtggaagctctggagcctgtaaacagagggatatag

SEQ ID NO: 16266 - protein, 80 aa, Linum usitatissimum
MSRSGQPPDLKKYMDKKLQIKLNANRMVVGTLRGFDQFMNLVIDNTVEVNGEEKTEIGMVVIRGNSVVTVEALEPVNRGI

SEQ ID NO: 16267 - DNA, 300 bp, Linum usitatissimum
  CDS (1)..(300)
atgtctggaagaaaagaaacggtcttggatttggcgaagtttgtggacaagggcgtctcagtcaagctcaccggtggtagacaagttacgggaacattgaaaggatatgatcagctgttaaaccttgtgctggatgaagcagtagagtttctacgagattctgacgatccactgaagactacagaccaaacgaggacacttggactaattgtctgcagagggactgctgtaatgttggtatcaccaactgatggtacagatgagattgccaacccctttgtccagccagatggtacctag

SEQ ID NO: 16268 - protein, 99 aa, Linum usitatissimum
MSGRKETVLDLAKFVDKGVSVKLTGGRQVTGTLKGYDQLLNLVLDEAVEFLRDSDDPLKTTDQTRTLGLIVCRGTAVMLVSPTDGTDEIANPFVQPDGT

SEQ ID NO: 16269 - DNA, 315 bp, Triticum aestivum
  CDS (1)..(315)
atgtcggggcgcaaggagacggtgctggacctggccaagttcgtcgacaagggcgtccaggtcaagctcaccggcggcaggcaagttacaggaactttgaagggctatgaccagcttctgaacttggtgcttgatgaagcgattgagtttgaaagagagcaagacgatccactgaaactgtcgacaaaaaccagacagcttggtctcattgtctgcaggggcacagcggtgatgcttgtatcgccaacggagggaacagaggagatcaaaaaccccttccaagaggctgatggagaacaaaccgctcactcctaa

SEQ ID NO: 16270 - protein, 104 aa, Triticum aestivum
MSGRKETVLDLAKFVDKGVQVKLTGGRQVTGTLKGYDQLLNLVLDEAIEFEREQDDPLKLSTKTRQLGLIVCRGTAVMLVSPTEGTEEIKNPFQEADGEQTAHS

SEQ ID NO: 16271 - DNA, 24 bp, Artificial sequence
  primer
atgcatcagcaacactcccaaagg

SEQ ID NO: 16272 - DNA, 27 bp, Artificial sequence
  primer
ctatttttgcatatatagtacatcaga

SEQ ID NO: 16273 - protein, 70 aa, Artificial sequence
  consensus sequence
  Variant (2)..(2): Xaa in position 2 is any amino acid
  Variant (4)..(5): Xaa in position 4 to 5 is any amino acid
  Variant (7)..(11): Xaa in position 7 to 11 is any amino acid
  Variant (13)..(15): Xaa in position 13 to 15 is any amino acid
  Variant (16)..(16): Xaa in position 16 is any or no amino acid
  Variant (18)..(20): Xaa in position 18 to 20 is any amino acid
  Variant (22)..(22): Xaa in position 22 is any amino acid
  Variant (24)..(24): Xaa in position 24 is any amino acid
  Variant (26)..(26): Xaa in position 26 is any amino acid
  Variant (28)..(30): Xaa in position 28 to 30 is any amino acid
  Variant (34)..(34): Xaa in position 34 is any amino acid
  Variant (36)..(38): Xaa in position 36 to 38 is any amino acid
  Variant (40)..(48): Xaa in position 40 to 48 is any amino acid
  Variant (49)..(62): Xaa in position 49 to 62 is any or no amino acid
  Variant (64)..(65): Xaa in position 64 to 65 is any amino acid
  Variant (66)..(66): Xaa in position 66 is any or no amino acid
  Variant (68)..(68): Xaa in position 68 is any amino acid
LXKXXDXXXXXKXXXXRXXXGXLXGXDXXXNLVXDXXXEXXXXXXXXXXXXXXXXXXXXXXXGXXXVXRG

SEQ ID NO: 16274 - protein, 28 aa, Artificial sequence
  protein pattern
  Variant (2)..(2): Xaa in position 2 is Phe or Leu
  Variant (3)..(3): Xaa in position 3 is any amino acid
  Variant (4)..(4): Xaa in position 4 is Ala or Gly
  Variant (5)..(5): Xaa in position 5 is Gly or Asn
  Variant (6)..(6): Xaa in position 6 is Lys or Arg
  Variant (7)..(7): Xaa in position 7 is any amino acid
  Variant (8)..(8): Xaa in position 8 is Ala, Ile or Val
  Variant (9)..(9): Xaa in position 9 is any amino acid
  Variant (11)..(11): Xaa in position 11 is any amino acid
  Variant (13)..(13): Xaa in position 13 is Lys or Arg
  Variant (15)..(15): Xaa in position 15 is Phe or Tyr
  Variant (17)..(17): Xaa in position 17 is any amino acid
  Variant (18)..(18): Xaa in position 18 is Phe or Leu
  Variant (19)..(19): Xaa in position 19 is Leu or Met
  Variant (23)..(23): Xaa in position 23 is Ile, Leu, Met or Val
  Variant (24)..(24): Xaa in position 24 is Asp or Glu
  Variant (25)..(25): Xaa in position 25 is Asp, Glu, Gly or Asn
  Variant (26)..(26): Xaa in position 26 is Ala, Ser, Thr or Val
  Variant (27)..(27): Xaa in position 27 is any amino acid
KXXXXXXXXGXLXGXDXXXNLVXXXXXE

SEQ ID NO: 16275 - DNA, 1092 bp, SACCHAROMYCES CEREVISIAE
  CDS (1)..(1092)
atgtttactcgaaggtttattccagttgttcagtcaactaagcaaaacatcggtaaatatgtgcgaaaagatgctaggttcactttattaacatacaacatgctctcaccgtcatatatgtggccacaggtatacacatacgttgcagagccatacaaaaactggagttataggcacagactgctggagaaagaacttttgaatactttcaaggctgatattatgtgtctccaagaaatgaccgcaagagattatgaagattattggcacgattccataggggtagatgtcaattatgggtccaaattcatttccaagacacccccaaagtattggaaaaaaccggttaaagatatggacggtgtatctattttctataatcttgcaaaatttgactttatatcgtcatcagggatctacttaaaccagctactgaatgttttcaatcaaagggaactgaaatacttatacaataagaaggtaacattaaccgatggtgcttccaatgttattggtgaagacagcttattggatgttttaaaaggcaagaatcaggtatgcttattcgtatctctaagacataaggagacgggtactatttttgtcgttttaaatactcatttgtattggaaatatgacgaagttaagctaacacaatgcatgattataatgagagagttatcaaagatcattaagcagctcctaccgggagatgtaaaaggccaagaaagggtgaagattttattcactggtgatctaaattctacaagagattcgctagttgttaattttctgcaaggtcagatagttagccatggagaccttaatcttattaacccaatgaggccgtatttggatcgttgtgtctatgacgatataccaaaggattattttgtacatacgtgctattcaggaaaattgaagggcatctttgattacgtatggtaccatgattcagattttttactaactaagatcctaaccggtaatgaagtatcagacgaattgctagcgtctaatcagttgggtttacccaatgaaaaccatcctagtgatcatatacctctactaacagaattcaaaatactgtga

SEQ ID NO: 16276 - protein, 363 aa, SACCHAROMYCES CEREVISIAE
MFTRRFIPVVQSTKQNIGKYVRKDARFTLLTYNMLSPSYMWPQVYTYVAEPYKNWSYRHRLLEKELLNTFKADIMCLQEMTARDYEDYWHDSIGVDVNYGSKFISKTPPKYWKKPVKDMDGVSIFYNLAKFDFISSSGIYLNQLLNVFNQRELKYLYNKKVTLTDGASNVIGEDSLLDVLKGKNQVCLFVSLRHKETGTIFVVLNTHLYWKYDEVKLTQCMIIMRELSKIIKQLLPGDVKGQERVKILFTGDLNSTRDSLVVNFLQGQIVSHGDLNLINPMRPYLDRCVYDDIPKDYFVHTCYSGKLKGIFDYVWYHDSDFLLTKILTGNEVSDELLASNQLGLPNENHPSDHIPLLTEFKIL

SEQ ID NO: 16277 - DNA, 1426 bp, Arabidopsis thaliana
  CDS (44)..(1210)
aatctaaagccaaattgggttaagtcaattgttgtcactatagatgtttagttctacaactctgcatcatcttcctcgtccgaatcttcttcttcccagctctcgtgtctgcaggaaagttatttcgagaagaatgagtacgaatcctgcaattgaaccaaaagttcgcaaatttgaatctgttgaaggagttgatattggttcaagaaataaatccgatggtatcagattccgtcttgtttcatataacatattagctcaggtttatgtgaagagtgcacttctcccacactctccacctgcctgtctcaaatggaaagctcgttcacatgcaattctcagcgttctcaaaaatctccaggctgatttcttttgtctgcaggaagtagatgagtacgatagcttttacagaaataacatggactctctgggatattctgggatttatattcagagaaccggccagaggaagcgtgatggttgtgcaatcttctacaagccaagctgtgcagagttagtcacaaaggaacggatcgaatataatgatcttgtggactcaataaaagcagatagtgtttcctgcagcgaacagaagattgagacatccaacgaaggaaaagattctcgaaaagacagtcgtgaccttaatgatccactagtgagactaaaacgtgattgcgttggaataatggctgcttttaggatcaacaagccgtttcagcatatcgttatcgtggcaaacacacatctttactgggaccctgaattggctgatgtcaagcttgctcaagccaagtatctactgtcacgactagctcagttcaaaacactaatatcagatgaatttgagtgcacaccttcattgctactagctggcgacttcaattcaattcctggggatatggtttatagttacctagtatcgggtaatgctaaacccacagagaccatagaagaagaagaagctccagttcctctgtctagtgtctatgaagtcacaagaggagagcctaagttcacaaattgcactcctggcttcacaaacacacttgactacatcttcatctctccttcagacttcattaaacctgtgagtatccttcaactacctgagccggattctccagatgttgtcggtttcttaccgaatcatcatcacccgagtgatcatttacctataggagctgagtttgagattcgtcgggaataggaagtttcgttctttagaaagttttgtcgcataactccattgtttcagcatttgaatatggttcttgtagaaatcatgaagcagtgaatcatacacacacaacacaaagtattaaaggacttggatcatttttgtctcaataaactcgaaattttcgttgtgtgcattgaattactgagaatatttgaattttcttgagaagaaattgtttaatgt

SEQ ID NO: 16278 - protein, 388 aa, Arabidopsis thaliana
MFSSTTLHHLPRPNLLLPSSRVCRKVISRRMSTNPAIEPKVRKFESVEGVDIGSRNKSDGIRFRLVSYNILAQVYVKSALLPHSPPACLKWKARSHAILSVLKNLQADFFCLQEVDEYDSFYRNNMDSLGYSGIYIQRTGQRKRDGCAIFYKPSCAELVTKERIEYNDLVDSIKADSVSCSEQKIETSNEGKDSRKDSRDLNDPLVRLKRDCVGIMAAFRINKPFQHIVIVANTHLYWDPELADVKLAQAKYLLSRLAQFKTLISDEFECTPSLLLAGDFNSIPGDMVYSYLVSGNAKPTETIEEEEAPVPLSSVYEVTRGEPKFTNCTPGFTNTLDYIFISPSDFIKPVSILQLPEPDSPDVVGFLPNHHHPSDHLPIGAEFEIRRE

SEQ ID NO: 16279 - DNA, 1077 bp, Drosophila melanogaster
  CDS (1)..(1077)
atgtgctataatgtgctctgcgacaagtacgcgacgcgacaaatgtacggatactgtccgtcgtgggcgctatgctgggagtaccgaaaaaagtcgattatcgacgagatacggcactatgcagcggacattatcagtctgcaggagatcgaaacggagcaattctatcacttcttcctgccggaactcaagaacgatgggtacgagggaatcttctcaccgaagtcgcgtgctaagactatgtccgagctggagaggaagtacgtcgatggctgtgcgatattcttcagggcgtccaagtttacgctgatcaaggaatcattgatcgagttcaatcagctggcaatggccaatgccgagggctccgacaacatgctgaaccgcgtaatgcctaaggataacatcggtctggccgcactgctcaaggtgaaggagaacgcatgggagccgatgtccgaggtgacgcagatctcgcagccgctgctcgtctgcacggcgcacatacactgggaccctgagttctgcgacgtcaagctcatccagacgatgatgcttagcaatgagttgaagacgatcatcgacgaggcgagccacagtttccgacctggtcacaagaacgactccaatgctgtccagctgctgctgtgcggtgacttcaactcgctacccgattcaggcgttgtggagtttctcggcaagggccgcgtttccatggatcatttggacttcaaggacatgggctacaagtcctgcctgcagcggctgctctcgaacgacaccaacgagtttacgcactcgttcaagctagcctccgcctacaacgaggacataatgccgcacaccaactatacgttcgattttaagggcatcatcgactacattttctacacgaagacgggcatggtgccgctgggcctgctgggtcctgtctccaatgattggctgcgcgagaataaggttgttggatgcccacatccgcatataccctctgatcacttcccactgctggtcgagctagagctgatgcatacggctagccaacaggcgcctcctaacgggctgatcaatcgccggtag

SEQ ID NO: 16280 - protein, 358 aa, Drosophila melanogaster
MCYNVLCDKYATRQMYGYCPSWALCWEYRKKSIIDEIRHYAADIISLQEIETEQFYHFFLPELKNDGYEGIFSPKSRAKTMSELERKYVDGCAIFFRASKFTLIKESLIEFNQLAMANAEGSDNMLNRVMPKDNIGLAALLKVKENAWEPMSEVTQISQPLLVCTAHIHWDPEFCDVKLIQTMMLSNELKTIIDEASHSFRPGHKNDSNAVQLLLCGDFNSLPDSGVVEFLGKGRVSMDHLDFKDMGYKSCLQRLLSNDTNEFTHSFKLASAYNEDIMPHTNYTFDFKGIIDYIFYTKTGMVPLGLLGPVSNDWLRENKVVGCPHPHIPSDHFPLLVELELMHTASQQAPPNGLINRR

SEQ ID NO: 16281 - DNA, 1405 bp, Arabidopsis thaliana
  CDS (113)..(1189)
aaagccaaattgggttaagtcaattgttgtcactatagatgtttagttctacaactctgcatcatcttcctcgtccgaatcttcttcttcccaggtggttatttcgagaagaatgagtacgaatcctgcaattgaaccaaaagttcgcaaatttgaatctgttgaaggagttgatattggttcaagaaataaatccgatggtatcagattccgtcttgtttcatataacatattagctcaggtttatgtgaagagtgcacttctcccacactctccacctgcctgtctcaaatggaaagctcgttcacatgcaattctcagcgttctcaaaaatctccaggctgatttcttttgtctgcaggaagtagatgagtacgatagcttttacagaaataacatggactctctgggatattctgggatttatattcagagaaccggccagaggaagcgtgatggttgtgcaatcttctacaagccaagctgtgcagagttagtcacaaaggaacggatcgaatataatgatcttgtggactcaataaaagcagatagtgtttcctgcagcgaacagaagattgagacatccaacgaaggaaaagattctcgaaaagacagtcgtgaccttaatgatccactagtgagactaaaacgtgattgcgttggaataatggctgcttttaggatcaacaagccgtttcagcatatcgttatcgtggcaaacacacatctttactgggaccctgaattggctgatgtcaagcttgctcaagccaagtatctactgtcacgactagctcagttcaaaacactaatatcagatgaatttgagtgcacaccttcattgctactagctggcgacttcaattcaattcctggggatatggtttatagttacctagtatcgggtaatgctaaacccacagagaccatagaagaagaagaagctccagttcctctgtctagtgtctatgaagtcacaagaggagagcctaagttcacaaattgcactcctggcttcacaaacacacttgactacatcttcatctctccttcagacttcattaaacctgtgagtatccttcaactacctgagccggattctccagatgttgtcggtttcttaccgaatcatcatcacccgagtgatcatttacctataggagctgagtttgagattcgtcgggaataggaagtttcgttctttagaaagttttgtcgcataactccattgtttcagcatttgaatatggttcttgtagaaatcatgaagcagtgaatcatacacacacaacacaaagtattaaaggacttggatcatttttgtctcaataaactcgaaattttcgttgtgtgcattgaattactgagaatatttgaattttcttgagaagaaattgtttaatgt

SEQ ID NO: 16282 - protein, 358 aa, Arabidopsis thaliana
MSTNPAIEPKVRKFESVEGVDIGSRNKSDGIRFRLVSYNILAQVYVKSALLPHSPPACLKWKARSHAILSVLKNLQADFFCLQEVDEYDSFYRNNMDSLGYSGIYIQRTGQRKRDGCAIFYKPSCAELVTKERIEYNDLVDSIKADSVSCSEQKIETSNEGKDSRKDSRDLNDPLVRLKRDCVGIMAAFRINKPFQHIVIVANTHLYWDPELADVKLAQAKYLLSRLAQFKTLISDEFECTPSLLLAGDFNSIPGDMVYSYLVSGNAKPTETIEEEEAPVPLSSVYEVTRGEPKFTNCTPGFTNTLDYIFISPSDFIKPVSILQLPEPDSPDVVGFLPNHHHPSDHLPIGAEFEIRRE

SEQ ID NO: 16283 - DNA, 1080 bp, Candida glabrata CBS 138
  CDS (1)..(1080)
atgctcgcaagacaatttataccaattggtgcaaacgttttaaagaacagtgcaaaaccattgtttacgttactaagttacaaccttttgtcaccctcatacatgtggcctcaggtgtatacgtatgtgcctgagaaatataaggattggaactatagacataaactcctcgaacaggagttgctagataagtatagagctgacattatgtgtctccaggagcttacatcagaagattatagtaacttttggaagaaagctcttcaaactaacatgaactacgggtcaaactatattgccaaaaccccgccgcaatattggaagagaccagttgagcaaatggacggtgttggcatattttacaatctggacaaatttgagttcatttccaggtctggaatatatcttaatcaattacttggtgttttcagtaataatgaattagagtatctcgaaaaaaagccagttacattgactgatggggccggtaatcaagtcggtgagcaaagtttgctccaaatcctaaaatcaaaaaatcaagtggctttattcgtatcattaaaacataaagaaaccggtaatgtttttgtcgttataaatacacatctgtattggaaatacgatgatgtgaagttaactcaatgtatgatcattatgagagaactggctagaataattgaaaaacatttagtcggtttagagaatgtaactgatgacaagattaaaattttattcactggagatttaaactcaacatcagactcattagttataaatttcttaaagggtcaaattgttagtcatgataatctgaatgttataaatcctatgaagccttatttagaacattgtgtctatgatgatgtaccagaagagttatttactcacacatgttattcaggaaaactgaagggtatttttgattacatatggtaccacgacacagacttcaaattgagacgtatactatctggtagagaagtatctcatgagcttgcagctttgaatcaatttggtctaccaaacgagaatcacccaagtgatcatattcctttgtttacagaatttgagattctgtga

SEQ ID NO: 16284 - protein, 359 aa, Candida glabrata CBS 138
MLARQFIPIGANVLKNSAKPLFTLLSYNLLSPSYMWPQVYTYVPEKYKDWNYRHKLLEQELLDKYRADIMCLQELTSEDYSNFWKKALQTNMNYGSNYIAKTPPQYWKRPVEQMDGVGIFYNLDKFEFISRSGIYLNQLLGVFSNNELEYLEKKPVTLTDGAGNQVGEQSLLQILKSKNQVALFVSLKHKETGNVFVVINTHLYWKYDDVKLTQCMIIMRELARIIEKHLVGLENVTDDKIKILFTGDLNSTSDSLVINFLKGQIVSHDNLNVINPMKPYLEHCVYDDVPEELFTHTCYSGKLKGIFDYIWYHDTDFKLRRILSGREVSHELAALNQFGLPNENHPSDHIPLFTEFEIL

SEQ ID NO: 16285 - DNA, 1116 bp, Kluyveromyces lactis NRRL Y-1140
  CDS (1)..(1116)
atgtttggacggaaacttttaccagtattgaagaagcttcctggtaagacaaaaattaagaccccttcgtcatcaatccaaggaccattcaatgacagatttactatgttgacatacaatatgctatccccgtattacatgtggccacaggtgtatacatatgtgaaggatgaatataaggattgggattatcgacataggctgctggaacatgagctattttacaagtacaagtcagatattatttgtttgcaggaattgactacaaacgattacaatgagttttggaagaaacaaatgatgaatagaatgaactacgggtccaacttcaccgcaaagacacctcccaaatattggacgaagcctttggaatgtatggatggggtaggaattttttacaatttggataagttcgagtacctgttttccagcagtttatatctcaatgatcttgttggaacgtttgatcaacaggagttacactacttaacccatcataatattacactcacaaatggtgcgggtgatgttattggcgaagatagtttatataatgtggctaaggcaagaaaccaagtgtgtcttttcgtaatgttacggcatagggaaagtaaatcgataatcgtggtaattaatacacacttatattggaaatacgatgaagtcaaattagtacaatgtttgatcattatgcggaaacttcaacggataattaaaggtcttttaatggggattgaaggagttacttactcgaatgtcaagattttgtttagcggagatttcaattcgtcacgagattctcttgtcatcaagtttttaaacggaaaaataatcaagcatggagacattaacctgcaaaatccaatgagagcttatttgagccattccatctacgacgatatccctgaagacgcttacgtccacacatgttattcaggcaaacttaagggcattttcgactatatatggttccatccaggagattttgaagtggaaaaagtactcagcggccaagaagtatcaaaagaactaacccatctaaatgatttcggtctccctaataaatatcatccgagtgatcatattcctgttttaacggaactaagaatactatga

SEQ ID NO: 16286 - protein, 371 aa, Kluyveromyces lactis NRRL Y-1140
MFGRKLLPVLKKLPGKTKIKTPSSSIQGPFNDRFTMLTYNMLSPYYMWPQVYTYVKDEYKDWDYRHRLLEHELFYKYKSDIICLQELTTNDYNEFWKKQMMNRMNYGSNFTAKTPPKYWTKPLECMDGVGIFYNLDKFEYLFSSSLYLNDLVGTFDQQELHYLTHHNITLTNGAGDVIGEDSLYNVAKARNQVCLFVMLRHRESKSIIVVINTHLYWKYDEVKLVQCLIIMRKLQRIIKGLLMGIEGVTYSNVKILFSGDFNSSRDSLVIKFLNGKIIKHGDINLQNPMRAYLSHSIYDDIPEDAYVHTCYSGKLKGIFDYIWFHPGDFEVEKVLSGQEVSKELTHLNDFGLPNKYHPSDHIPVLTELRIL

SEQ ID NO: 16287 - DNA, 1221 bp, Debaryomyces hansenii CBS767
  CDS (1)..(1221)
atgtattttgattcgaaactgactaaacttgacgacataacttggtcagatatgcacaaattaatatctagaaatggtaaggaaagcatattatgtatcggtcaacgattatactcaaacatgagaatacccttgaattatgatgctaccaagtaccgaaactggcatcattttgatgagccctcaaccagtaagaagcaaaagatatcggtgatgtcattcaatttactctcccgtcattatatgtggaagccagtatttggctatttggaacaggagtatctaagctggtcagattatcgttttccattgatcaatttaatgataagacagttcaattgtgatatcatgtgtttccaagagatggagcacctaatatatgaaaaattttggtccaaaggctttccatctcctaattaccattcattctacgtaagaaagctggagcctgtctattggggagataggccgtcggagaatatcgatggtgttgggatatttgtcaatggagacaagtttgatgtcttggacagtcatgcgatccactttggggagtatatcatgcagcatcacgtcaaatttaacgtcacgaaggcaacagttgagcgagtcataccacgcaatacagtggcacttctagtcaagttacgcgataaacaaaacggtaagatattgtatgtgacaaatactcatttatattggtctcccaagtttaacgacgtcaaaatcatccaaaccaaactccttttgaacgtcttgcatgacttcatagaccacaattgcctatgtgacccatgtatcattatgtgtggtgattttaattcaaacccgtcttcgaaagtattccaattgctcaacaccggcaccatcgatgcctttaagtgcaacgagttcgctcttcacgactacgaccataaagcaaatagcgaattgttccacaatggacatattgaaaaccccttccatctagcatgtgcctatgagctgcttcttacccattcacatattaatcccagaaagaaattggagtttacatcgtttacgaaaggcttgatcgacgttgtggatcatatttggtattccaaaaaccacttcaaagtcacaaaactacttggagaggtcgaccaatcttactacacggaaaccggggtggtcggcttccccaatagtcagtttccctctgaccacattcctttagtaactgaactagcatacctttag

SEQ ID NO: 16288 - protein, 406 aa, Debaryomyces hansenii CBS767
MYFDSKLTKLDDITWSDMHKLISRNGKESILCIGQRLYSNMRIPLNYDATKYRNWHHFDEPSTSKKQKISVMSFNLLSRHYMWKPVFGYLEQEYLSWSDYRFPLINLMIRQFNCDIMCFQEMEHLIYEKFWSKGFPSPNYHSFYVRKLEPVYWGDRPSENIDGVGIFVNGDKFDVLDSHAIHFGEYIMQHHVKFNVTKATVERVIPRNTVALLVKLRDKQNGKILYVTNTHLYWSPKFNDVKIIQTKLLLNVLHDFIDHNCLCDPCIIMCGDFNSNPSSKVFQLLNTGTIDAFKCNEFALHDYDHKANSELFHNGHIENPFHLACAYELLLTHSHINPRKKLEFTSFTKGLIDVVDHIWYSKNHFKVTKLLGEVDQSYYTETGVVGFPNSQFPSDHIPLVTELAYL

SEQ ID NO: 16289 - DNA, 25 bp, Artificial sequence
  primer
atgtttactcgaaggtttattccag

SEQ ID NO: 16290 - DNA, 27 bp, Artificial sequence
  primer
tcacagtattttgaattctgttagtag

SEQ ID NO: 16291 - protein, 359 aa, Artificial sequence
  consensus sequence
  Variant (3)..(3): Xaa in position 3 is any amino acid
  Variant (5)..(7): Xaa in position 5 to 7 is any amino acid
  Variant (9)..(23): Xaa in position 9 to 23 is any amino acid
  Variant (25)..(26): Xaa in position 25 to 26 is any amino acid
  Variant (28)..(40): Xaa in position 28 to 40 is any amino acid
  Variant (41)..(41): Xaa in position 41 is any or no amino acid
  Variant (43)..(44): Xaa in position 43 to 44 is any amino acid
  Variant (49)..(51): Xaa in position 49 to 51 is any amino acid
  Variant (52)..(53): Xaa in position 52 to 53 is any or no amino acid
  Variant (55)..(56): Xaa in position 55 to 56 is any amino acid
  Variant (58)..(66): Xaa in position 58 to 66 is any amino acid
  Variant (67)..(67): Xaa in position 67 is any or no amino acid
  Variant (69)..(81): Xaa in position 69 to 81 is any amino acid
  Variant (82)..(89): Xaa in position 82 to 89 is any or no amino acid
  Variant (92)..(93): Xaa in position 92 to 93 is any amino acid
  Variant (96)..(108): Xaa in position 96 to 108 is any amino acid
  Variant (110)..(111): Xaa in position 110 to 111 is any amino acid
  Variant (113)..(113): Xaa in position 113 is any amino acid
  Variant (115)..(125): Xaa in position 115 to 125 is any amino acid
  Variant (126)..(135): Xaa in position 126 to 135 is any or no amino acid
  Variant (137)..(140): Xaa in position 137 to 140 is any amino acid
  Variant (141)..(145): Xaa in position 141 to 145 is any or no amino acid
  Variant (147)..(171): Xaa in position 147 to 171 is any amino acid
  Variant (172)..(175): Xaa in position 172 to 175 is any or no amino acid
  Variant (177)..(177): Xaa in position 177 is any amino acid
  Variant (184)..(187): Xaa in position 184 to 187 is any amino acid
  Variant (188)..(189): Xaa in position 188 to 189 is any or no amino acid
  Variant (193)..(193): Xaa in position 193 is any amino acid
  Variant (195)..(201): Xaa in position 195 to 201 is any amino acid
  Variant (203)..(219): Xaa in position 203 to 219 is any amino acid
  Variant (220)..(233): Xaa in position 220 to 233 is any or no amino acid
  Variant (235)..(236): Xaa in position 235 to 236 is any amino acid
  Variant (239)..(239): Xaa in position 239 is any amino acid
  Variant (242)..(246): Xaa in position 242 to 246 is any amino acid
  Variant (248)..(250): Xaa in position 248 to 250 is any amino acid
  Variant (252)..(274): Xaa in position 252 to 274 is any amino acid
  Variant (275)..(275): Xaa in position 275 is any or no amino acid
  Variant (277)..(296): Xaa in position 277 to 296 is any amino acid
  Variant (297)..(311): Xaa in position 297 to 311 is any or no amino acid
  Variant (315)..(320): Xaa in position 315 to 320 is any amino acid
  Variant (322)..(342): Xaa in position 322 to 342 is any amino acid
  Variant (343)..(344): Xaa in position 343 to 344 is any or no amino acid
  Variant (347)..(349): Xaa in position 347 to 349 is any amino acid
  Variant (354)..(354): Xaa in position 354 is any amino acid
  Variant (356)..(358): Xaa in position 356 to 358 is any amino acid
YNXLXXXYXXXXXXXXXXXXXXXWXXRXXXXXXXXXXXXXXDXXCLQEXXXXXYXXFXXXXXXXXXXYXXXXXXXXXXXXXXXXXXXXXDGXXIFXXXXXXXXXXXXXIXXNXLXXXXXXXXXXXXXXXXXXXXXGXXXXXXXXXLXXXXXXXXXXXXXXXXXXXXXXXXXXXXXVXNTHLYWXXXXXXVKLXQXXXXXXXLXXXXXXXXXXXXXXXXXXXXXXXXXXXXXXXLXXGDXNSXXXXXVXXXLXXXXXXXXXXXXXXXXXXXXXXXXYXXXXXXXXXXXXXXXXXXXXXXXXXXXXXXXXXXXDYIXXXXXXFXXXXXXXXXXXXXXXXXXXXXXXPNXXXPSDHXPXXXE

SEQ ID NO: 16292 - protein, 19 aa, Artificial sequence
  protein pattern
  Variant (2)..(3): Xaa in position 2 to 3 is any amino acid
  Variant (4)..(4): Xaa in position 4 is any or no amino acid
  Variant (6)..(6): Xaa in position 6 is any or no amino acid
  Variant (11)..(11): Xaa in position 11 is Phe, Ile or Leu
  Variant (13)..(13): Xaa in position 13 is Ile, Leu or Val
  Variant (14)..(14): Xaa in position 14 is any amino acid
  Variant (15)..(15): Xaa in position 15 is Ala, Thr or Val
  Variant (17)..(17): Xaa in position 17 is Phe or Leu
  Variant (18)..(18): Xaa in position 18 is Glu, Lys or Arg
  Variant (19)..(19): Xaa in position 19 is Ile or Leu
PXXXHXPSDHXPXXXEXXX

SEQ ID NO: 16293 - protein, 16 aa, Artificial sequence
  protein pattern
  Variant (2)..(5): Xaa in position 2 to 5 is any amino acid
  Variant (6)..(8): Xaa in position 6 to 8 is any or no amino acid
  Variant (10)..(10): Xaa in position 10 is any amino acid
KXXXXXXXVXNTHLYW

SEQ ID NO: 16294 - protein, 21 aa, Artificial sequence
  protein pattern
  Variant (2)..(2): Xaa in position 2 is Cys or Asn
  Variant (3)..(3): Xaa in position 3 is any amino acid
  Variant (4)..(4): Xaa in position 4 is Ser or Thr
  Variant (5)..(6): Xaa in position 5 to 6 is any amino acid
  Variant (7)..(7): Xaa in position 7 is Phe or Leu
  Variant (8)..(8): Xaa in position 8 is any amino acid
  Variant (9)..(9): Xaa in position 9 is Gly or Asn
  Variant (10)..(10): Xaa in position 10 is any amino acid
  Variant (11)..(11): Xaa in position 11 is Phe, Ile or Leu
  Variant (14)..(14): Xaa in position 14 is any amino acid
  Variant (15)..(20): Xaa in position 15 to 20 is any or no amino acid
TXXXXXXXXXXDYXXXXXXXF

SEQ ID NO: 16295 - protein, 16 aa, Artificial sequence
  protein pattern
  Variant (3)..(3): Xaa in position 3 is Ile, Leu, Met or Val
  Variant (5)..(5): Xaa in position 5 is Ala, Cys or Ser
  Variant (6)..(6): Xaa in position 6 is Asp, Pro or Gln
  Variant (7)..(7): Xaa in position 7 is any amino acid
  Variant (9)..(11): Xaa in position 9 to 11 is any amino acid
  Variant (12)..(12): Xaa in position 12 is Ala or Gln
  Variant (13)..(13): Xaa in position 13 is Leu, Met or Val
  Variant (14)..(14): Xaa in position 14 is any amino acid
  Variant (15)..(15): Xaa in position 15 is Gly, Pro or Thr
  Variant (16)..(16): Xaa in position 16 is His or Tyr
YNXLXXXYXXXXXXXX

SEQ ID NO: 16296 - protein, 12 aa, Artificial sequence
  protein pattern
  Variant (2)..(2): Xaa in position 2 is Phe or Ile
  Variant (3)..(3): Xaa in position 3 is Phe, Ile or Met
  Variant (4)..(4): Xaa in position 4 is Cys or Ser
  Variant (8)..(8): Xaa in position 8 is Ile, Leu, Met or Val
  Variant (9)..(9): Xaa in position 9 is Asp, Glu or Thr
  Variant (10)..(10): Xaa in position 10 is Ala, Glu, Ser or Thr
  Variant (11)..(11): Xaa in position 11 is any amino acid
  Variant (12)..(12): Xaa in position 12 is Asp or Gln
DXXXLQEXXXXX

SEQ ID NO: 16297 - protein, 23 aa, Artificial sequence
  protein pattern
  Variant (3)..(3): Xaa in position 3 is Phe or Leu
  Variant (6)..(7): Xaa in position 6 to 7 is any amino acid
  Variant (8)..(8): Xaa in position 8 is Asp or Gly
  Variant (9)..(9): Xaa in position 9 is Asp or Ser
  Variant (10)..(10): Xaa in position 10 is any amino acid
  Variant (12)..(13): Xaa in position 12 to 13 is any amino acid
  Variant (14)..(14): Xaa in position 14 is Phe or Tyr
  Variant (16)..(19): Xaa in position 16 to 19 is any amino acid
  Variant (20)..(20): Xaa in position 20 is Ala, Ile or Val
  Variant (21)..(22): Xaa in position 21 to 22 is any amino acid
  Variant (23)..(23): Xaa in position 23 is Asp, Gly or Thr
GDXNSXXXXXVXXXLXXXXXXXX

SEQ ID NO: 16298 - protein, 18 aa, Artificial sequence
  protein pattern
  Variant (2)..(2): Xaa in position 2 is any or no amino acid
  Variant (6)..(6): Xaa in position 6 is any amino acid
  Variant (8)..(8): Xaa in position 8 is Ala, Cys or Thr
  Variant (9)..(10): Xaa in position 9 to 10 is any amino acid
  Variant (11)..(11): Xaa in position 11 is Ile or Leu
  Variant (12)..(12): Xaa in position 12 is any amino acid
  Variant (13)..(13): Xaa in position 13 is Asn, Arg or Ser
  Variant (14)..(14): Xaa in position 14 is Glu, Lys or Arg
  Variant (16)..(17): Xaa in position 16 to 17 is any amino acid
  Variant (18)..(18): Xaa in position 18 is Phe or Ile
DXVKLXQXXXXXXXLXXX

SEQ ID NO: 16299 - DNA, 354 bp, SACCHAROMYCES CEREVISIAE
  CDS (1)..(354)
atggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgagaaaaaaaatataaaagagatggaggaacgggaaaaagttagttgtggtgataggtggcaagtggtattccgtaagaacaacaagaaaagcatttcatattatggctga

SEQ ID NO: 16300 - protein, 117 aa, SACCHAROMYCES CEREVISIAE
MVPTMFPPPKVFLCSDTDYLKLQHTIYIHVYICIPMNVSKYVYEQYDTEDDKVMHHSIRVILNEARFPFFFLLFLFFSLELEKKNIKEMEEREKVSCGDRWQVVFRKNNKKSISYYG

SEQ ID NO: 16301 - DNA, 4949 bp, Saccharomyces cerevisiae
  CDS (2397)..(2798)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgcccgggcgatctagacttaagcgatatcgaagcgtagtctggaacgtcgtatgggtaggaatcggccaacgcgcggggagaggcggtttgcgtattgggcgccagggtggtttttcttttcaccagtgagacgggcaacagccaagctccggatccgtgcctaccacctcttagccttagcacaagatgtaaggtggactccttctgaatgttgtaatcagacagcgttctaccgtcttctagctgcttaccggcaaagatcaatctttgttgatctggagggataccttccttgtcttgaattttcgacttaacgttgtcgatggtatcggaagattcaacttccaatgttatggttttaccggtcaaagtcttgacgaaaatctgcataatatcgatgttttagtgtgtgaatgaaataggtgtatgttttctttttgctagacaataattaggaacaaggtaagggaactaaagtgtagaataagattaaaaaagaagaacaagttgaaaaggcaagttgaaatttcaagaaaaaagtcaattgaagtacagtaaattgacctgaatatatctgagttccgacaacaatgagtttaccgaagagaacaatggaataggaaactttgaacgaagaaaggaaagcaggaaaggaaaaaatttttaggctcgagaacaatagggcaaaaaaacaggcaacgaacgaacaatggaaaaacgaaaaaaaaaaaacacagaaaagaatgcagaaagttgtaaactgaaaaaaaaaaaaaaaaggtgaacacaggaaaaaaaataaaaaaaaaaaaaaaggaggacgaaacaaaaaagtgaaaaaaaatgaaaatttttttggaaaaccaagaaatgaattatatttccgtgtgagacgacatcgtcgaatatgattcaggtacccgggctgttccctagcatgtacgtgagcgtatttccttttaaaccacgacgctttgtcttcattcaacgtttcccattgtttttttctactattgctttgctgtgggaaaaacttatcgaaagatgacgactttttcttaattctcgttttaagagcttggtgagcgctaggagtcactgccaggtatcgtttgaacacggcattagtcagggaagtcataacacagtcctttcccgcaattttctttttctattactcttggcctcctctagtacactctatatttttttatgcctcggtaatgattttcatttttttttttccacctagcggatgactctttttttttcttagcgattggcattatcacataatgaattatacattatataaagtaatgtgatttcttcgaagaatatactaaaaaatgagcaggcaagataaacgaaggcaaagatgacagagcagaaagccctagtaaagcgtattacaaatgaaaccaagattcagattgcgatctctttaaagggtggtcccctagcgatagagcactcgatcttcccagaaaaagaggcagaagcagtagcagaacaggccacacaatcgcaagtgattaacgtccacacaggtatagggtttctggaccatatgatacatgctctggccaagcattccggctggtcgctaatcgttgagtgcattggtgacttacacatagacgaccatcacaccactgaagactgcgggattgctctcggtcaagcttttaaagaggccctactggcgcgtggagtaaaaaggtttggatcaggatttgcgcctttggatgaggcactttccagagcggtggtagatctttcgaacaggccgtacgcagttgtcgaacttggtttgcaaagggagaaagtaggagatctctcttgcgagatgatcccgcattttcttgaaagctttgcagaggctagcagaattaccctccacgttgattgtctgcgaggcaagaatgatcatcaccgtagtgagagtgcgttcaaggctcttgcggttgccataagagaagccacctcgcccaatggtaccaacgatgttccctccaccaaaggtgttcttatgtagtgacaccgattatttaaagctgcagcatacgatatatatacatgtgtatatatgtatacctatgaatgtcagtaagtatgtatacgaacagtatgatactgaagatgacaaggtaatgcatcattctatacgtgtcattctgaacgaggcgcgctttccttttttctttttgctttttctttttttttctcttgaactcgagaaaaaaaatataaaagagatggaggaacgggaaaaagttagttgtggtgataggtggcaaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 16302 - protein, 133 aa, Saccharomyces cerevisiae
MVPTMFPPPKVFLCSDTDYLKLQHTIYIHVYICIPMNVSKYVYEQYDTEDDKVMHHSIRVILNEARFPFFFLLFLFFSLELEKKNIKEMEEREKVSCGDRWQGMQAWRNHGHSCFLCEIVIRSQFHTTYEPEA

SEQ ID NO: 16303 - DNA, 23 bp, Artificial sequence
  primer
atggtaccaacgatgttccctcc

SEQ ID NO: 16304 - DNA, 26 bp, Artificial sequence
  primer
tcagccataatatgaaatgcttttct

SEQ ID NO: 16305 - DNA, 471 bp, SACCHAROMYCES CEREVISIAE
  CDS (1)..(471)
atgttcgccagactcgctaatcctgcccacttcaagcctctcacgggctcccacataacaagagctgccaaaagactttaccatcctaaggtaattgaccactacacaaacccaagaaacgttgggtccatggataagtccttagctaatgtcggcacaggaatcgtgggcgcccctgcgtgtggtgatgtgataaaactacaaatacaggtgaatgataaatcgggtattatcgagaacgttaagttcaagaccttcgggtgtgggtctgccatcgcttcctcctcctacatgaccgagctggtacgcggtatgtcacttgatgaggccgttaaaattaaaaacacggaaatcgcgaaggagctaagtcttcctccagtaaaactgcattgttccatgcttgcagaagacgctatcaaggcggcaatcaaggactacaaaacaaagaggaacccctccgttttgcattga

SEQ ID NO: 16306 - protein, 156 aa, SACCHAROMYCES CEREVISIAE
MFARLANPAHFKPLTGSHITRAAKRLYHPKVIDHYTNPRNVGSMDKSLANVGTGIVGAPACGDVIKLQIQVNDKSGIIENVKFKTFGCGSAIASSSYMTELVRGMSLDEAVKIKNTEIAKELSLPPVKLHCSMLAEDAIKAAIKDYKTKRNPSVLH

SEQ ID NO: 16307 - DNA, 906 bp, Glycine max
  CDS (38)..(556)
gactcgtcgaccgcaaaagagaaaaaaaaaaacaaaaatgctgagaatcgccgcaagcgcaaagagaattgttcaaacggcgtcgttggaggcgccaccgttggggattagggttctgccgcgtctctaccacgagagggtggtggaccactacgacaacccccgcaacgttggatccttcgacaagaacgaccccaccgtcggaacgggtcttgttggtgcacccgcgtgtggcgacgtcatgaagctccagattaaggttgacgacaaaacggggaagatcgtcgatgctcgcttcaaaaccttcggttgtggatccgctattgcttcttcctccgtcgctactgaatgggtgaagggaaagcaaatggaggaagttttgaccattaaaaacactgaaattgcaaagcatctttcacttccaccagtcaagcttcactgcagcatgcttgctgaggatgctataaaagcagctgttaaagattatgaagctaagcgtgcctcagcatctgctggtggacagactacaactggagagaaagctgccactgcttgattacttccatttctagaacgatgatgaaaacaaccaatagtatggttttctgacaggactcaatgaacactgtatgaacatcttgaggtcagacttctcttggttggagctagtcattgtgattggattgtattaatgtgaagtaaatacttgtgtcgctagctgtagtttgttatctgcatggtttatagaagtcaaaccatgtttttattaaaatatgtacacaatagaataaagctatgatatttacatggggaacttggaaccatgtaaatacctttcctgaagtaaacagcgactcatatttaccctataaaggtttggaccttatgtttatctgttattcaacc

SEQ ID NO: 16308 - protein, 172 aa, Glycine max
MLRIAASAKRIVQTASLEAPPLGIRVLPRLYHERVVDHYDNPRNVGSFDKNDPTVGTGLVGAPACGDVMKLQIKVDDKTGKIVDARFKTFGCGSAIASSSVATEWVKGKQMEEVLTIKNTEIAKHLSLPPVKLHCSMLAEDAIKAAVKDYEAKRASASAGGQTTTGEKAATA

SEQ ID NO: 16309 - DNA, 961 bp, Sorghum bicolor
  CDS (87)..(632)
gcacgaggagcaaaagaaaagaactcgctccgaaccctgcgatcagaagaatccagactccagaggcgactccaggtttgtgggagatgctgcgcgcaggaggcaggctgctcctcgccccggggctccggcggttcggcctgggcaccggcgccgccgccggcgaggcgggccctgccgccgcggcggcgggggtgagggcgtaccacgagcgggtggtggaccactacaacaacccgcggaacgtcggttccttcgacaaggaggaccccaacgtcggcactgggctggtcggcgcgccggcctgcggggacgtcatgaagctgcagatccgcgtcgacgaggactccggcaagatcgtcgacgcctgcttcaagacctttggctgcggctccgccatcgcgtcctcgtccgtcgctactgaatgggtcaagggaaaaccaatggatgaagttttgacaatcaagaacactgagattgcaaaacacttgtcccttccaccagtaaagctccattgcagcatgcttgctgaggatgcgattaaagctgctgtgaaagactacgaagccaagaaggtgaagatggggcaaaagggtgtagacagtccttcagagaaggctgctgaagcatgaaagtttctgccatgaagtatactgagctgatatgtttctcagtccatgactccctgccacttattgttgccaaagataaatgcttctgtttgtgaggcgagggattgtgtgtaatgttcacaaactctggtagtacggcttgtggcttaactcttttaaggatggtgacgaccaatttcaaataaatttgctaccatcttagaattagaagaaagtacttctatgtgcatgtacaagagctgtttctagaagtgttatctgtcaacatacgtaatggaattacggtcaccgttgcaaaaaaaaaataaaaaaaaaaaaaagggcgggcc

SEQ ID NO: 16310 - protein, 181 aa, Sorghum bicolor
MLRAGGRLLLAPGLRRFGLGTGAAAGEAGPAAAAAGVRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKVKMGQKGVDSPSEKAAEA

SEQ ID NO: 16311 - DNA, 801 bp, Zea mays
  CDS (79)..(555)
tacaggtagtggttgtttagtgcgttgttattttgcctgtaattcttcgtgacagatcgcattacaacacacttgaccatggcgtgggtctctccgttagctagaataggtgcatccactctcctcaaagctcgttctcaaagtcttccagcggctctttaccatgaaaaggtgattgatcactatgaaaatcctcggaatgttggaaccctcgacaagaaaaaatcctcagttggtactggattggtcggagcaccagcatgtggtgatgtcatgaaacttcaggtggaagtggatgaaaatggaaagattgttgatgccaaatttaagacctttggttgtggatctgcaatagcgtcatcatccttagcaacagaatgggtgaaaggaaaaacggttgatgaagcattgaaactcaagaacaccgatatagccaaggaattgtgcctaccgcctgtgaaacttcactgttctatgttagctgaggatgccatcaaagcagctttggcagactatcgtatcaagcaggaatcattgaaaaatcagtctgcttaaatcatgaagaaacaaactttcatttatatctagttaaggattgtgctattgtgatattctgtgtgatctgtatggaatgaaagaggtcttacaagctcgtttaatgaaataacttcttgctttcttgcgttgcttcgcagcaaaaatagtttcttttactgggaggggagaatcatttgatgtgtgcatgattctatggtgttgtttgtgcaaagagtagtgccataaataaaattaatactgagg

SEQ ID NO: 16312 - protein, 158 aa, Zea mays
MAWVSPLARIGASTLLKARSQSLPAALYHEKVIDHYENPRNVGTLDKKKSSVGTGLVGAPACGDVMKLQVEVDENGKIVDAKFKTFGCGSAIASSSLATEWVKGKTVDEALKLKNTDIAKELCLPPVKLHCSMLAEDAIKAALADYRIKQESLKNQSA

SEQ ID NO: 16313 - DNA, 1050 bp, Zea mays
  CDS (112)..(654)
cctcgagtcgggccgcggggaccaggcccaaacgaagagaaaagagaagaacctcaatccggaagcgaaaaggaccagaagaaaccagaggcgactccaggttcgtgggcgatgctgcgcgcgggaggtaggcagctccttgccccggggctccggcggctcggtctgggcaccggcgccgccggtgaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcatgcttgcggaggatgccattaaagctgctgtgaaagactacgaagccaagaaggcgaagatggggcaaaagagtgaagacagtccatcagagaaagctgctgaagcatgaaagtttctgccttttttaagtgtaattgagctgatatgtttctcagtccatgactccccgctgcttaagataaatgcttctgattgcgaggcgaggcgagggaccgcgtgtaatgttcacaaattctggtagtgcggcatgtgccttaactcttttgaggatggtgacaaccaatttcaaataaatttggtgccatcttagaattagaagtactatgtggatatcacatagtggaagtgttttctgtcaactacataattgaattacggccgtcgttgcacggaggctattttaaaatgttgtattgtatgtggtatggattcgcttacgggcctgaaactgttctattggaatcgataattttatttatactaaaaaaaaaaaaaaaaaaaaaaa

SEQ ID NO: 16314 - protein, 180 aa, Zea mays
MLRAGGRQLLAPGLRRLGLGTGAAGEVGPAAAAAGMRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKAKMGQKSEDSPSEKAAEA

SEQ ID NO: 16315 - DNA, 965 bp, Zea mays
  CDS (88)..(630)
  misc_feature (931)..(931): n is a, g, c or t
cccacgcgtccggagaaaagaaaaccgctccaatccggaagctgaaaatagcagaagaatccagaggcgactccaggtttgttggcgatgctgcgagcgggaggcaggcggctcctcgccccggggctccgtcggctcggcctgggcacaggcgcctccggcgaggcgggtcctgccgcggcggcggcgggcgtgagggcgtaccacgagcgggtggtggaccactacaacaacccgcggaacgtaggttccttcgacaaggacgaccccaacgtcggcactgggttggtcggcgcgccggcctgcggcgacgtcatgaagctgcagatccgcgtcgacgagaactccggcaagatcgtcgacgcctgcttcaagacttttggctgcggctccgccatagcgtcctcgtccgtcgctactgaatgggtgaagggaaaaccaatggatgaagttttgacaatcaagaacacggagatcgcgaagcacttgtcccttccaccagtaaagctccattgcagcatgcttgccgaggatgcgattaaagctgctgtaaaagactacgaagccaagaagtcaaagatggggcagaagggtgaagacagcccttcacagaaggctgctgaagcatgaaaggttctgccgtgaagtatattgtgctgatacgtttctcagtccatgactccccgccgcatattgccaaagataaatgcttctgtttgtgaggcgagggattgtgtgtaatgttcacgaactgtggtagtgcggcatgtgactcaactgttttaaggatggtgatgaccaatttcaaataaatttgctgccatcgtagaattagaagtactatgtggatttacaggagctgtttctggaatttgtagtatcatgttactttttttttcaagaatgttactgttggtattggcagacctgnggcggcaaccgacaatatagattgaagattgacg

SEQ ID NO: 16316 - protein, 180 aa, Zea mays
MLRAGGRRLLAPGLRRLGLGTGASGEAGPAAAAAGVRAYHERVVDHYNNPRNVGSFDKDDPNVGTGLVGAPACGDVMKLQIRVDENSGKIVDACFKTFGCGSAIASSSVATEWVKGKPMDEVLTIKNTEIAKHLSLPPVKLHCSMLAEDAIKAAVKDYEAKKSKMGQKGEDSPSQKAAEA

SEQ ID NO: 16317 - DNA, 1012 bp, Triticum aestivum
  CDS (180)..(707)
  misc_feature (1012)..(1012): n is a, g, c or t
accgcccctgtttggccccgaaaaaccgcccctcccgactcggcagatcgtcagcagagagagaaaccggccaccccgcatgttggcgacgttgcctcccgagtttgcccaggttaaacaacccatccggagccggagaacgtcagaagaatccagaggcacccccgagtttgttggcgatgttgcgcgcgggaggaagccggctcgtcgcccccggactccggcgtctcctcggcccgggcgccggcgagagggctgcgccggggctggcggcggcgggggcgagggcgtaccacgagcgggtggtggaccactacaacaacccgcggaacgtcgggtctttcgacaaggacgaccccaacgtcggcaccgggctggtcggcgcgccggcctgcggcgacgtcatgaagctgcagatccgtgtcgacgaaggcaccgggaagatagtcgacgcctgcttcaagaccttcggctgcggctccgcaatcgcgtcgtcctccgtcgctactgaatgggtgaagggaaagcaaatggaggaagtagtgagtatcaagaacactgagattgcaaagcacttgtcacttccaccagtaaagctccattgcagtatgcttgctgaagatgcaattaaagctgccgtgaaagattatgaatcaaagaaggcgaagctgggagacagccctgcagagaaggctgccgaagcatgaacatgatatatgcttctgttctatgagggtgagaaatggtgtgcaatgttcacaaactccagtgttgtagcatgtatcataaggatgaacacgaacaatttgaaataaatgtgctgtcatgttaggagaagttgtgcatgtatagcagctgctacgaaaatttgtgcatgtatagcaactgcttggaagtcgtaatagtacacttgatgtcatttgcccgttctaaaaaatattcggttctatattgctggttattttggaacaaaaaaaaaaaaaaaaaaaaaaaaaaaaaaaaaaaaaaaaan

SEQ ID NO: 16318 - protein, 175 aa, Triticum aestivum
MLRAGGSRLVAPGLRRLLGPGAGERAAPGLAAAGARAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 16319 - DNA, 652 bp, Gossypium hirsutum
  CDS (15)..(506)
aaccaaccctactcatgaaaatgttgaggatggtgtcgaagaagctgctcgggattccctccccatcgcctcccctacagactctgccacgtctttaccaccagaatgtcatcgatcactacaacaatcctcgtaacgtcggttccttcgacaagaacgaccccaacgttggtaccggcctggtcggcgctcctgcttgcggtgatgttatgaagttgcaaatcaaaatcgacgaggattcgggcaaaatcgttgatgcttgctttaaaaccttcggttgtggctcggccattgcctcttcttctgttgctactgaatgggtgaaagggaaaagcatggacgaagtgcttactattaaaaacacggagatcgcgaaacatctatcacttcccccagttaagctgcactgcagtatgcttgctgaagatgcaattaaggcagctgtgaaagatgctgaagctaaacgtggcaaaatgaatggtaattccaaggctgctgatgcctgatgtatgtggatatgctaaggaaagaactctggaaactttgattatcatctaatcgtatgtaaagttagaagatagcatgcacccgggggggggggggggggggggggggggggggggggcggggggggggggggggggggggggta

SEQ ID NO: 16320 - protein, 163 aa, Gossypium hirsutum
MKMLRMVSKKLLGIPSPSPPLQTLPRLYHQNVIDHYNNPRNVGSFDKNDPNVGTGLVGAPACGDVMKLQIKIDEDSGKIVDACFKTFGCGSAIASSSVATEWVKGKSMDEVLTIKNTEIAKHLSLPPVKLHCSMLAEDAIKAAVKDAEAKRGKMNGNSKAADA

SEQ ID NO: 16321 - DNA, 696 bp, Gossypium hirsutum
  CDS (56)..(580)
tcggaacctagaaagctctttctttggcagtgaaaattgaaaatcgacggcgaaaatgttgaggctggcgtcgaaacggttgcttgggctaacgtcaagggagatcccgtcacggtccgttcagattctgccacgtctttaccacgaaaacgtcatcgaacactacaacaatccccgtaacgtcggttccttcgataagaacgatccgaacgtcggcaccggtttggtcggagctcctgcttgtggcgatgttatgaagcttcaaatcaaaatcgacgaggaatcggggaagattgttgatgcttgctttaaaacattcggttgtggatcggcgattgcgtcttcttctgttgctactgaatgggtgaaggggaaaagcatggacgaggttcttaccattaaaaacacggagattgcgaaacatctatcacttccaccggttaagctgcattgcagtatgcttgcagaagatgctataaaggcggccgtaaaagacatggaacttaaacgtgccaagttgaagggcaattcaagtgctgatgctgctaatgcacccatcgagaaggctgctgatgcctgatgtctgtttatatgcccgattgtaaaaaaagtctgaacggtttgcttacagagagcatgtaaggtaagactaaaataaaaccagggggggacattctgaggacacatgtaatgtta

SEQ ID NO: 16322 - protein, 174 aa, Gossypium hirsutum
MLRLASKRLLGLTSREIPSRSVQILPRLYHENVIEHYNNPRNVGSFDKNDPNVGTGLVGAPACGDVMKLQIKIDEESGKIVDACFKTFGCGSAIASSSVATEWVKGKSMDEVLTIKNTEIAKHLSLPPVKLHCSMLAEDAIKAAVKDMELKRAKLKGNSSADAANAPIEKAADA

SEQ ID NO: 16323 - DNA, 816 bp, Zea mays subsp. mays
  CDS (124)..(642)
gtgaggcgtgagcgccacacccacacgaaggatcccgaagccgaagagaaccctaccgaggaggcagaaaatccgtaggcgcgcctcatacgattccgagatccgtgcctcttatcggcagccatgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtcggcgcgccggcgtgcggggacgtcatgaagctgcagatccgcgtcgacgaggggtccggcaggatcgtcgacgcgcgcttcaagaccttcggctgcggctccgccatcgcgtcctcctccgtcgcttccgaatgggtcaagggcaagcaagtggaggaagtggtggccatcaagaacaccgagattgcgaagcacctgtctcttccaccagtgaagctccactgcagcatgctcgctgaggacgcaatcaaggccgccgtgaaggattacgaggcaaagaaagggaagaagatggccaaggcagaggagcaggacaccccatgcccgtaagagcgacagctagtaaactgaagcgagcagagagtactgtatgtagtatgtaacggctaacgagcgaggtactcgtgtcgtgtgtgccaaaagaagcatgtatgtaatgtaaagctaggtaacaacgatgtttgggtttcatagaataagcgaacttgccgcagtgtttttttt

SEQ ID NO: 16324 - protein, 172 aa, Zea mays subsp. mays
MMLRAAGRRLLGVGGGDPAPAVAAAVAASRSRGYHERVVDHYNNPRNVGSLDKDDTDVGTGIVGAPACGDVMKLQIRVDEGSGRIVDARFKTFGCGSAIASSSVASEWVKGKQVEEVVAIKNTEIAKHLSLPPVKLHCSMLAEDAIKAAVKDYEAKKGKKMAKAEEQDTPCP

SEQ ID NO: 16325 - DNA, 462 bp, Archaeoglobus fulgidus DSM 4304
  CDS (1)..(462): transl_table=11
atgtatagcgacaaggttttcgaccacttccagaatccgaggaatgtcggaaagattgaggatgctgatggtgtgggaactgtcggcaatccagtttgcggggatttgatgaccatttacattaaagtgaaggacaacagaattgaggatatcaagttccagacctttggctgcgctgctgccattgcaaccagcagcatggccactgagatggcgaaggggaaaactatagaggaagctctgaaaattacaagagatgctgttgccgaagcccttggcggtttgccgaagcagaaaatgcactgctccaacttggccgcagatgcgctgaggagggcaatagttgactactttagaaaaaatggaaaaattgataagataaaggagttaggtctggaaaaggaacttgagaagatggagaagggtgagatggacgaccacggagagtattgtgaggcttga

SEQ ID NO: 16326 - protein, 153 aa, Archaeoglobus fulgidus DSM 4304
MYSDKVFDHFQNPRNVGKIEDADGVGTVGNPVCGDLMTIYIKVKDNRIEDIKFQTFGCAAAIATSSMATEMAKGKTIEEALKITRDAVAEALGGLPKQKMHCSNLAADALRRAIVDYFRKNGKIDKIKELGLEKELEKMEKGEMDDHGEYCEA

SEQ ID NO: 16327 - DNA, 462 bp, Mesorhizobium loti MAFF303099
  CDS (1)..(462): transl_table=11
atgcgggataataccgacaacgtctacctcttcagcgacaagctctatttcatcaatccgcacaatgtcggcgttttggacatccccaatgcagccggcgaggtcggcgccgtcgcctgcggcgacgggcttaaattgatgatgggtttcgaccccaagaccgagacgattactgccgcaacgttccagaccttcggccgcggctcggccataaccgcttcctcgacaattacccaattcatcgtcggcaagaccatcgatgaagcccttcagatcaccgatcaggaaatggcagattttctcggcgccctgccgccgcacacgatatactcatcgctcgaccgcctcattttggagcgcggtttgcggctgatgagcgagttcttccatgctgtgaggcaggctttcgaggagacgccaggattctcacgcctcgtcctcgtcaaggcatcatcgccatga

SEQ ID NO: 16328 - protein, 153 aa, Mesorhizobium loti MAFF303099
MRDNTDNVYLFSDKLYFINPHNVGVLDIPNAAGEVGAVACGDGLKLMMGFDPKTETITAATFQTFGRGSAITASSTITQFIVGKTIDEALQITDQEMADFLGALPPHTIYSSLDRLILERGLRLMSEFFHAVRQAFEETPGFSRLVLVKASSP

SEQ ID NO: 16329 - DNA, 492 bp, Arabidopsis thaliana
  CDS (1)..(492)
atgatgatgctaaggcaaacgtcgagaaaggcttacctagggttacaggcgtctcctctagggttaggtcgtcgattataccacgagaatgtaatcgaccactttgaaaaccctagaaacgttggctccttcaacaggaatgaccctaacgttggcacgggattggtaggagctcctgcctgcggagacctcatgagcctccagattaaggtcgatgattcaggtcagatcattgatactcgattcaagacctttggctgtggctccgctatcgcctcatcttccgttgcttctgaatggatcaagggcaaaaccttagacgaagttatgaccatcaagaacgcggaaatcgctaagcatcttaggttgccaccggtaaagctacattgcagtatgcttgcagaggacgctatcaagtccgcggtcagagactacaaggagaagcaagcaaagactaatgctgctgctgcagaagaaaccgtcaaggcctga

SEQ ID NO: 16330 - protein, 163 aa, Arabidopsis thaliana
MMMLRQTSRKAYLGLQASPLGLGRRLYHENVIDHFENPRNVGSFNRNDPNVGTGLVGAPACGDLMSLQIKVDDSGQIIDTRFKTFGCGSAIASSSVASEWIKGKTLDEVMTIKNAEIAKHLRLPPVKLHCSMLAEDAIKSAVRDYKEKQAKTNAAAAEETVKA

SEQ ID NO: 16331 - DNA, 504 bp, Arabidopsis thaliana
  CDS (1)..(504)
atgatgctcaagcaagctgcgaagaaggccctagggcttacgtcacgtcaatcaacaccgtggtctgttggtatcctccgaacctaccatgagaacgtcatcgaccactacgataatccccgcaacgttgggtctttcgataagaatgatcccaacgttggtacgggactcgtaggagctcccgcttgtggtgatgtgatgaagcttcaaatcaaggtcgatgagaagactggtcaaatcgttgatgctcgctttaagacttttggttgtggttcagccatcgcttcttcatctgttgccactgaatgggtgaaaggcaaagctatggaggatgttctgaccatcaaaaacaccgaaatcgcaaagcatctttctctcccaccagtcaagctccactgcagtatgttggcggaggacgctatcaaggcagctgtgaaagactacaaggagaagcgtgtgaagacaaatggtgctgcagcagcaggagaaaccacacaggcttga

SEQ ID NO: 16332 - protein, 167 aa, Arabidopsis thaliana
MMLKQAAKKALGLTSRQSTPWSVGILRTYHENVIDHYDNPRNVGSFDKNDPNVGTGLVGAPACGDVMKLQIKVDEKTGQIVDARFKTFGCGSAIASSSVATEWVKGKAMEDVLTIKNTEIAKHLSLPPVKLHCSMLAEDAIKAAVKDYKEKRVKTNGAAAAGETTQA

SEQ ID NO: 16333 - DNA, 387 bp, Pasteurella multocida subsp. multocida str. Pm70
  CDS (1)..(387): transl_table=11
atggcatacagtaataaagtgattgatcattatgaaaatccacgtaacgttggatctttagataaaaaagatgcaaacgtggggactggcatggtaggtgcacctgcttgtggtgatgtgatgcaacttcaaattaaagtcagtgaagaaggcattattgaagatgcaaaattcaaaacttacggttgtggttcagcgatcgcttcaagttctttaattacagaatgggtgaaaggcaaatcacttgatgaagcacaggcgattaaaaacagccaaatcgcagaagaattagaattaccacctgtgaaagttcactgttcaattttagctgaagatgcaatcaaagctgcgattgcagactacaaagcaaaaaaagaagcaaaataa

SEQ ID NO: 16334 - protein, 128 aa, Pasteurella multocida subsp. multocida str. Pm70
MAYSNKVIDHYENPRNVGSLDKKDANVGTGMVGAPACGDVMQLQIKVSEEGIIEDAKFKTYGCGSAIASSSLITEWVKGKSLDEAQAIKNSQIAEELELPPVKVHCSILAEDAIKAAIADYKAKKEAK

SEQ ID NO: 16335 - DNA, 387 bp, Salmonella typhimurium LT2
  CDS (1)..(387): transl_table=11
atggcttacagcgaaaaagtaatcgatcactatgagaacccgcgtaacgtagggtcgtttgacaacaacgacgataacgtgggaagcggcatggttggcgcgccggcctgcggcgacgtcatgaagttgcagattaaagttaacgatgaaggtatcattgaagacgcgcgcttcaagacttacggctgcggttccgctatcgcctccagttctctggtaacggagtgggtgaaagggaaatccctggacgaagcgcaggcgattaaaaacaccgacattgcagacgaactggaactgccgccggtgaaaattcactgctctattctggcggaagacgcgattaaagccgctattgcggattacaaaagcaaacgcgaagcgaaataa

SEQ ID NO: 16336 - protein, 128 aa, Salmonella typhimurium LT2
MAYSEKVIDHYENPRNVGSFDNNDDNVGSGMVGAPACGDVMKLQIKVNDEGIIEDARFKTYGCGSAIASSSLVTEWVKGKSLDEAQAIKNTDIADELELPPVKIHCSILAEDAIKAAIADYKSKREAK

SEQ ID NO: 16337 - DNA, 402 bp, Ralstonia solanacearum GMI1000
  CDS (1)..(402): transl_table=11
atgtcttacagcagcaaggttctggaccactacgaaaacccccgcaacgtcggcgccttcgagaagggcgacgacacggtcggcaccggcatggtcggcgcgccggcgtgcggcgacgtgatgaagctgcagatcaaggtcaacgagcagggcgtgatcgaggacgcgaagttcaagacctacggctgcggctcggccatcgcctcgtcgtcgctggtgaccgagtgggtcaagggcaagacgctggatcaagcgctggagatccgcaacacgcagatcgccgaagagctggcgctgccgccggtgaagatccactgctcgatcctggccgaggacgccatcaaggcggccgtggctgactacaaggaaaagcacggcaccgccgaacagaaggctgcctga

SEQ ID NO: 16338 - protein, 133 aa, Ralstonia solanacearum GMI1000
MSYSSKVLDHYENPRNVGAFEKGDDTVGTGMVGAPACGDVMKLQIKVNEQGVIEDAKFKTYGCGSAIASSSLVTEWVKGKTLDQALEIRNTQIAEELALPPVKIHCSILAEDAIKAAVADYKEKHGTAEQKAA

SEQ ID NO: 16339 - DNA, 429 bp, Clostridium perfringens str. 13
  CDS (1)..(429): transl_table=11
atgatatatagtgaaaaagttatggatcatttcaaaaacccaagaaatgtaggagaaattaaagacgctaacggaatcggagaagttggtaacgctaaatgtggagatataatgagaatatatcttaaaatagaaaataacattgtagaagatgttaaatttgaaacttatggatgtggatctgctatagcttcatcaagtatggctacagagcttataaaaggaaaaactgtagaagaagcttgggaattatcaaacaaagctgttgcagaagctttagatggtcttccaccagtaaaaatgcactgttcagtattagctgaggaagctatacacaaggctataaacgactatagacaaagacaaggattagagccttgggatatgaaagaacattcacatgacatacatgagcatgttcacggttaa

SEQ ID NO: 16340 - protein, 142 aa, Clostridium perfringens str. 13
MIYSEKVMDHFKNPRNVGEIKDANGIGEVGNAKCGDIMRIYLKIENNIVEDVKFETYGCGSAIASSSMATELIKGKTVEEAWELSNKAVAEALDGLPPVKMHCSVLAEEAIHKAINDYRQRQGLEPWDMKEHSHDIHEHVHG

SEQ ID NO: 16341 - DNA, 387 bp, Fusobacterium nucleatum subsp. nucleatum ATCC 25586
  CDS (1)..(387): transl_table=11
atgaaatttatgcaatatacagaaaaagttatgcaacactttatgaaccctcataatgtaggggtaattgaaaatccagatggatacggaaaagtaggaaatccatcttgtggggatataatggaaatttttattaaggttgataataacataatctcagatgtaaaatttagaacatttggttgtgcatcagctattgcaagttcttcgatttcaactgatatgattataggaaagactgttgaggaagccttaaaacttactaacaaacaagttgttgatgaattaggtggattaccagcagttaaaatgcactgttcagttttagcagaagaagctattaaaatggcaatcgaagactatatctcaaaaagagatggaaaataa

SEQ ID NO: 16342 - protein, 128 aa, Fusobacterium nucleatum subsp. nucleatum ATCC 25586
MKFMQYTEKVMQHFMNPHNVGVIENPDGYGKVGNPSCGDIMEIFIKVDNNIISDVKFRTFGCASAIASSSISTDMIIGKTVEEALKLTNKQVVDELGGLPAVKMHCSVLAEEAIKMAIEDYISKRDGK

SEQ ID NO: 16343 - DNA, 387 bp, Methanosarcina acetivorans C2A
  CDS (1)..(387): transl_table=11
atggattacagcgctaaggtgttagaccatttttcaaacccgagaaacatggggagtattgcgaactgcgacggagtgggagaggtcgggaacgcaaagtgcggagatataatgaagatctttctcaaggtcgaaggggacaggatcgttgacgtgaagttccagaccttcggatgcggggctgcaattgcatcaagcagcatggcaaccgaacttatcaaaggaaaaatcctgaaagaagcctgggaactttcgaataaagcagttgcagaggcacttgacgggctccctccgataaaaatgcactgttccatgcttgcggaagaggcaatccatgaggcaattaacgactatctgcagaaaaaagggcttgagccctgggactga

SEQ ID NO: 16344 - protein, 128 aa, Methanosarcina acetivorans C2A
MDYSAKVLDHFSNPRNMGSIANCDGVGEVGNAKCGDIMKIFLKVEGDRIVDVKFQTFGCGAAIASSSMATELIKGKILKEAWELSNKAVAEALDGLPPIKMHCSMLAEEAIHEAINDYLQKKGLEPWD

SEQ ID NO: 16345 - DNA, 381 bp, Methanosarcina acetivorans C2A
  CDS (1)..(381): transl_table=11
atgtacaataaaaaggtgatggaccattttatgaatccgagaaacgtgggggaaatagaggacgctgacggcataggagaagccggaaacccgcatggggatcagatgaaaattttcctgaaaatccgggacaacaggattgaagatgtaaaattcaagacatttggatgtgcagcagcaatcgcatccagcagcatggcaaccgaactgataaaaggcaagacccttgaagaagcctgggagcttacaaacgaagacgtggctgaagcgcttgaaggtcttcctccgggaaaactggagtgttctgtagtttccagagaagcaacccacatggcaatcaatgattaccgaaaaaagcagggacttgaacctcttaaatga

SEQ ID NO: 16346 - protein, 126 aa, Methanosarcina acetivorans C2A
MYNKKVMDHFMNPRNVGEIEDADGIGEAGNPHGDQMKIFLKIRDNRIEDVKFKTFGCAAAIASSSMATELIKGKTLEEAWELTNEDVAEALEGLPPGKLECSVVSREATHMAINDYRKKQGLEPLK

SEQ ID NO: 16347 - DNA, 429 bp, Methanosarcina mazei Go1
  CDS (1)..(429): transl_table=11
atgaaaaatgaatacaaaggacgcaagtgggggaattttgtgtataataagaaagtaatggaccattttatgaatccgagaaacgtgggggaaatagaaaatgcggatggcatcggagaagcaggaaaccctcacggggaccagatgaagatcttcctgaaaatacgggacaacagaatagaagatgtaaagttcaagacttttggctgtgcagcagcaatagcttccagcagcatggcaactgaaatgataaagggcaaaacccttgaagaagcctgggagcttacagatgaagctgtagccgaagcccttgaagggctgcctccgggaaaacttgaatgttcggtagtttcgagggaagctacccacagagcgatcaatgattaccgcaaaaagcaggggcttgaacctctggaagaaaagacctga

SEQ ID NO: 16348 - protein, 142 aa, Methanosarcina mazei Go1
MKNEYKGRKWGNFVYNKKVMDHFMNPRNVGEIENADGIGEAGNPHGDQMKIFLKIRDNRIEDVKFKTFGCAAAIASSSMATEMIKGKTLEEAWELTDEAVAEALEGLPPGKLECSVVSREATHRAINDYRKKQGLEPLEEKT

SEQ ID NO: 16349 - DNA, 660 bp, Methanosarcina mazei Go1
  CDS (1)..(660): transl_table=11
atgaaaatcgaaaagaaaagtgagatgaagtttccttatagtgaaaaagttcttgagcatttcaggaacccgcataatgtggggaagatagagaaccctgacggaaaaggcctggaaggaagccctgcatgcggggatatggttgcagtatacattaaggtcgaccccaggacaaaggtcattgaggatataaaattcgaatcttacggatgtgcatccaacattgccactgggtccgtaatcacagaccttgcacgtggaaagaccctggatgaagctaaaaaaataacctggaaacaggcttcagaagagcttgatggccttcctccgataaaagcccactgttccgtgcttgctgttgagggcctgcgtgccgcaatccgggactacgaagaaaaacacgggctcgtcacagagaaagaaccgacgacggaagaggttgtccagcagaggctcaaacacgttatgaaccctctgacaggtcttgatgttgttcgcaccaaccttatacttaaaacgagtgttgaagcaggagttatcagggtggttgttgacctgcccgcagaccaccagtttgctccggcaataaaagaggatataattgaaaagctcggggctctctgggatgtggaaagagtagatgtggtgtttacagcctga

SEQ ID NO: 16350 - protein, 219 aa, Methanosarcina mazei Go1
MKIEKKSEMKFPYSEKVLEHFRNPHNVGKIENPDGKGLEGSPACGDMVAVYIKVDPRTKVIEDIKFESYGCASNIATGSVITDLARGKTLDEAKKITWKQASEELDGLPPIKAHCSVLAVEGLRAAIRDYEEKHGLVTEKEPTTEEVVQQRLKHVMNPLTGLDVVRTNLILKTSVEAGVIRVVVDLPADHQFAPAIKEDIIEKLGALWDVERVDVVFTA

SEQ ID NO: 16351 - DNA, 465 bp, Drosophila melanogaster
  CDS (1)..(465)
atgtccctggtgcgaaactcctcccggttgctgcgatcgcagctgaagcgcgtacaaagtgtcccggtggcattgtatcatgaaaatgtcgttgagcactacgaaaacccgcgcaacgtgggatctttggacaagaaggatgtcactgtgggcaccggcttggtcggagcaccagcctgcggcgatgtgatgaaactgcagatcaaggtggacgagaacggcaagatagtggacgccaagttcaagaccttcggctgtggatcggccattgccagcagctccctggccaccgagtgggtgaagggcaagtccatcgacgaggccggaaagctgaagaatacggacatcgccaaggagctgcgtctgccgcccgtcaagctgcattgctccatgctggccgaggatgccatcaaggcggccctggctgactacaaggtcaagcagcagaagaaggtggccaactga

SEQ ID NO: 16352 - protein, 154 aa, Drosophila melanogaster
MSLVRNSSRLLRSQLKRVQSVPVALYHENVVEHYENPRNVGSLDKKDVTVGTGLVGAPACGDVMKLQIKVDENGKIVDAKFKTFGCGSAIASSSLATEWVKGKSIDEAGKLKNTDIAKELRLPPVKLHCSMLAEDAIKAALADYKVKQQKKVAN

SEQ ID NO: 16353 - DNA, 387 bp, Yersinia pestis KIM
  CDS (1)..(387): transl_table=11
atggcttacagcgaaaaagtaatcgatcattacgaaaatccacgcaacgtggggtcgttcgacagtcaagaccctactattggtagtggcatggttggcgcacccgcttgtggtgatgtcatgaagttgcagatcaaagtgaatgaagccggtattattgaagacgcccgctttaagacttatggttgcggttctgccatcgcctccagctctttagtcactgaatggatgaaaggcaagtctctcgatcaggctgaagccatcaaaaatactcagattgctgaagaactggagttaccgccagtcaagattcactgctcaattttggcagaagatgctattaaagccgcaatcgccgactacaaaagcaagcatactgccaagtaa

SEQ ID NO: 16354 - protein, 128 aa, Yersinia pestis KIM
MAYSEKVIDHYENPRNVGSFDSQDPTIGSGMVGAPACGDVMKLQIKVNEAGIIEDARFKTYGCGSAIASSSLVTEWMKGKSLDQAEAIKNTQIAEELELPPVKIHCSILAEDAIKAAIADYKSKHTAK

SEQ ID NO: 16355 - DNA, 387 bp, Pseudomonas putida KT2440
  CDS (1)..(387): transl_table=11
atggcatacagtgaaaaggtcatcgaccactacgaaaacccgcgcaacgtcggcaagatgaatgccgaggacccggatgtcggcaccggcatggtcggcgccccggcctgcggtgacgtgatgcgtctgcagatcaaggtcaacgagcagggcgttatcgaagacgccaagttcaagacctacggctgcggttcggccatcgcgtccagctccctcgccaccgagtggatgaagggcaagaccctggacgaggccgaaaccatcaagaatacccaactggccgaagagctggcgttgccgccggtcaagattcactgctcggtactcgccgaagatgccatcaaggcagccgtacgcgactacaagcagaagaaaggcttgatctaa

SEQ ID NO: 16356 - protein, 128 aa, Pseudomonas putida KT2440
MAYSEKVIDHYENPRNVGKMNAEDPDVGTGMVGAPACGDVMRLQIKVNEQGVIEDAKFKTYGCGSAIASSSLATEWMKGKTLDEAETIKNTQLAEELALPPVKIHCSVLAEDAIKAAVRDYKQKKGLI

SEQ ID NO: 16357 - DNA, 384 bp, Vibrio vulnificus CMCP6
  CDS (1)..(384): transl_table=11
atggcatacagcgaaaaagtaattgatcactatgagaacccacgtaacgttggttcgtttgacaaagaagatccatcggtaggtagcggcatggttggtgctcctgcatgtggtgacgtaatgaaactgcaaatcaaagtaacgccagaaggcatcattgaagacgcaaagttcaagacctacggttgtggtagtgcgattgcatcaagctcattggttaccgaatgggtaaaaggcaagagcatcgaagaagcggcttcgatcaaaaactcggaaattgcagaagagctcgagttgcctccagtgaaagtgcactgttcaattcttgcagaagatgcaatcaaagccgcagtggctgactacaagaaaaaacaccaactttaa

SEQ ID NO: 16358 - protein, 127 aa, Vibrio vulnificus CMCP6
MAYSEKVIDHYENPRNVGSFDKEDPSVGSGMVGAPACGDVMKLQIKVTPEGIIEDAKFKTYGCGSAIASSSLVTEWVKGKSIEEAASIKNSEIAEELELPPVKVHCSILAEDAIKAAVADYKKKHQL

SEQ ID NO: 16359 - DNA, 477 bp, Clostridium tetani E88
  CDS (1)..(477): transl_table=11
ttgggaagattatttaaaaagtctaaaggaaggggagaaataattatgatgccatatagtgataaagttatggaacattttagaaatccaagaaatgtaggagaaatttcagatgcaaatggagttggagaagttggaaatcctaaatgcggagatataatgaaaatatatttaaaagttgaagataatataataaaagatgttaaattcaaaacttttgggtgtggctctgctatagcttcttcaagtatggcaactgagttaataaaagggaagactttagaagaagcttgggaattatctaataaggcagtagctgatgcattagatggattaccaccagtaaaaatgcactgctcagtattagcagaagaagctatccataaggctataaatgattatagggagtctataggtttagagccttgggaaatgaaagttcactcggatcatatacatgatgaagtgcacggatga

SEQ ID NO: 16360 - protein, 158 aa, Clostridium tetani E88
MGRLFKKSKGRGEIIMMPYSDKVMEHFRNPRNVGEISDANGVGEVGNPKCGDIMKIYLKVEDNIIKDVKFKTFGCGSAIASSSMATELIKGKTLEEAWELSNKAVADALDGLPPVKMHCSVLAEEAIHKAINDYRESIGLEPWEMKVHSDHIHDEVHG

SEQ ID NO: 16361 - DNA, 387 bp, Pseudomonas syringae pv. tomato str. DC3000
  CDS (1)..(387): transl_table=11
atggcttacagcgaaaaggtcatcgaccactacgaaaacccgcgcaacgtcggcaagatgaacgcggaagaccctgatgtgggcaccggcatggtcggcgctcctgcgtgcggcgacgtgatgcgcctgcagatcaaggtcaacgagcacggcgttatcgaagacgccaagttcaagacctacggctgcggctcggcaattgcctccagctcgctggccaccgagtggatgaagggcaagactctggatgaagcagagaccatcaaaaacactcagctggcggaagagctggcgctgcctccggtaaagatccactgctcggtactcgccgaagacgccatcaaggcggctgttcgtgactacaagcagaagaagggcctgctgtaa

SEQ ID NO: 16362 - protein, 128 aa, Pseudomonas syringae pv. tomato str. DC3000
MAYSEKVIDHYENPRNVGKMNAEDPDVGTGMVGAPACGDVMRLQIKVNEHGVIEDAKFKTYGCGSAIASSSLATEWMKGKTLDEAETIKNTQLAEELALPPVKIHCSVLAEDAIKAAVRDYKQKKGLL

SEQ ID NO: 16363 - DNA, 384 bp, Vibrio parahaemolyticus RIMD 2210633
  CDS (1)..(384): transl_table=11
atggcatacagcgaaaaagtaattgatcactacgagaacccgcgtaacgttggttcatttgacaaagaagacccatcagtaggtagcggcatggttggcgctccagcttgtggtgacgtaatgaaactgcaaatcaaagtgacaccggaaggtatcatcgaagatgcgaagttcaaaacttacggttgtggtagtgcaatcgcgtcaagctcactagtcacagagtgggtaaaaggcaaatcaattgatgaagcggctgcaattaagaactctgaaattgcagaagagctagaacttccacctgtgaaagttcactgttcaattcttgctgaagacgcaatcaaagcagcggttgctgactacaagaaaaaacaccaagaataa

SEQ ID NO: 16364 - protein, 127 aa, Vibrio parahaemolyticus RIMD 2210633
MAYSEKVIDHYENPRNVGSFDKEDPSVGSGMVGAPACGDVMKLQIKVTPEGIIEDAKFKTYGCGSAIASSSLVTEWVKGKSIDEAAAIKNSEIAEELELPPVKVHCSILAEDAIKAAVADYKKKHQE

SEQ ID NO: 16365 - DNA, 384 bp, Haemophilus ducreyi 35000HP
  CDS (1)..(384): transl_table=11
atggcgtatagcgataaagtaatagaccattatgagaaccctcgtaatgttggcacctttgataaagaagctactgatgttggaactggaatggtaggtgcaccagcctgtggtgatattttacgtttacaaattaaagtcaatgacgatggcattattgaagatgcacgttttaaagcctatggctgtggttcagcaattgcctctagctcactgattaccgaatgggtaaaaggaaaatcattggacgaagctggagcgattaagaatagtgatattgcagaagagcttgaattacccccagtgaaagtacactgttcaattcttgcagaagatgcaattaaagcagcaattgctgactataaagaaaagcaagctaaataa

SEQ ID NO: 16366 - protein, 127 aa, Haemophilus ducreyi 35000HP
MAYSDKVIDHYENPRNVGTFDKEATDVGTGMVGAPACGDILRLQIKVNDDGIIEDARFKAYGCGSAIASSSLITEWVKGKSLDEAGAIKNSDIAEELELPPVKVHCSILAEDAIKAAIADYKEKQAK

SEQ ID NO: 16367 - DNA, 384 bp, Chromobacterium violaceum ATCC 12472
  CDS (1)..(384): transl_table=11
atggcatatagcgaaaaagtgttggatcactacgaaaatccgcgcaacgtcggctcgttcgacaagggcgacgacagcatcggcaccggcatggtcggcgcgccggcctgtggcgacgtgatgaagctgcagatcaaggtgggcgcggacggcgtgatcgaagacgccaagttcaagacctacggctgcggctccgccatcgcctcctcgtccctggtgaccgagtgggtgaagggcaagtcgctggacgaggcgctggcgatcaagaacaccgccatcgccgaagagctggcgctgccgccggtgaagatccactgctccatcctggccgaagacgcgatcaaggccgcggtggaagactacaagcagaaacacggcaagtaa

SEQ ID NO: 16368 - protein, 127 aa, Chromobacterium violaceum ATCC 12472
MAYSEKVLDHYENPRNVGSFDKGDDSIGTGMVGAPACGDVMKLQIKVGADGVIEDAKFKTYGCGSAIASSSLVTEWVKGKSLDEALAIKNTAIAEELALPPVKIHCSILAEDAIKAAVEDYKQKHGK

SEQ ID NO: 16369 - DNA, 387 bp, Photorhabdus luminescens subsp. laumondii TTO1
  CDS (1)..(387): transl_table=11
atggcttacagcgaaaaagtaattgatcactatgaaaatccacgtaacgtcggttctttcgatagtgaagatccaatggttggcagcggcatggttggtgcccctgcgtgtggtgatgtgatgaaactgcaaatcaaagtcaataatgaaggcattattgaagatgcgcgtttcaaaacttacggttgcggttctgcgattgcttccagctctttagttactgaatggatgaagggcaaatctctggagcaggcagaagcgattaaaaatactgaaattgccgatgaattagaattgccgccagtgaaaatccactgttctattctggctgaagatgcgattaaagcagcgattgcggattacaaaagtaaacgccagggcagataa

SEQ ID NO: 16370 - protein, 128 aa, Photorhabdus luminescens subsp. laumondii TTO1
MAYSEKVIDHYENPRNVGSFDSEDPMVGSGMVGAPACGDVMKLQIKVNNEGIIEDARFKTYGCGSAIASSSLVTEWMKGKSLEQAEAIKNTEIADELELPPVKIHCSILAEDAIKAAIADYKSKRQGR

SEQ ID NO: 16371 - DNA, 396 bp, Geobacter sulfurreducens PCA
  CDS (1)..(396): transl_table=11
atggctgagatttattcggcgaaggtatgggatcacgtgcgcaacccgcgcaatgtggggtcactggaggatgccaacgtggtggtacaggcaggcgaccccacctgtggcgatgcggtgctctacttcctcaggatcgaagaggatatcgtgcgcgacatcaaatttctcatcaagggatgtggtgcggccatcgccacatcgtcagtggcaacggagcttgtcatgggcaaggggctcgacgaggtcatggggctctccgatcagatcatcgcccaggcccttgacgggctccccgaagagaagatgcactgctcgaacatggcggcttcggcgctccacgcggcggtcgagcaataccgtgcaacagtggcgggtgagacgaagcccttatga

SEQ ID NO: 16372 - protein, 131 aa, Geobacter sulfurreducens PCA
MAEIYSAKVWDHVRNPRNVGSLEDANVVVQAGDPTCGDAVLYFLRIEEDIVRDIKFLIKGCGAAIATSSVATELVMGKGLDEVMGLSDQIIAQALDGLPEEKMHCSNMAASALHAAVEQYRATVAGETKPL

SEQ ID NO: 16373 - DNA, 492 bp, Strongylocentrotus purpuratus
  CDS (1)..(492)
atgccaatttctagcaatgcaagacttcttgggaagactctgcggcccctgctggcagcaaagtttagtcagccaggtcctgcatcagcttcgtatcacaaaaatgtgatcgaccactatgagaaccccaggaacgtgggagccatggacaagaacgacaagaacgttggtacaggattggtcggcgcaccggcgtgtggagacgtcatgaaactacaggttcaaatttcggataaaaagcatggcattgataatgttgccatctcagatgttggatgctgtagtttgatgtctacatcaatggaatataccaatctgtgccgaggtatgcatgtggatgaggcaaaggacatcaagaacacagacatcgccaaagaattgagtctgccccctgtcaagttacattgctcaatgctggctgaggatgctatcaaggcggcgctacaggactacagggtcaagcaggattccaaggaagcagcaacgaactaa

SEQ ID NO: 16374 - protein, 163 aa, Strongylocentrotus purpuratus
MPISSNARLLGKTLRPLLAAKFSQPGPASASYHKNVIDHYENPRNVGAMDKNDKNVGTGLVGAPACGDVMKLQVQISDKKHGIDNVAISDVGCCSLMSTSMEYTNLCRGMHVDEAKDIKNTDIAKELSLPPVKLHCSMLAEDAIKAALQDYRVKQDSKEAATN

SEQ ID NO: 16375 - DNA, 492 bp, Chlamydomonas reinhardtii
  CDS (1)..(492)
atgctcgcgtcgctgcttccctcggccgcttcggccctctccgcgcctgctgtgggtgccctgcccctcctggcgcagcagctaggccggcgcctgtaccacaagaacgtagtggagcactatgagcgcccccgcaacgttggctcgttcgacaagagcgaccccgacgttggcaccggcctcgtgggcgctcctgcatgcggcgatgtcatgaagctgcaaattaaggtggacgagcagggcaacatcgtggacgcgcgctttaagacgtttggatgcggttcggccatcgccagcagcagcgtggcgacggagtgggtgaagggcaagtcgctggacgaggtgttaaagattaagaacagcgacatcgccaagcatctcagcctgccgcccgtcaagctgcactgcagcatgctggcggaggatgccatcaaggctgcggtgaaggacatccaggcgaagcgcactaagaccgccaccgcggcagcttag

SEQ ID NO: 16376 - protein, 163 aa, Chlamydomonas reinhardtii
MLASLLPSAASALSAPAVGALPLLAQQLGRRLYHKNVVEHYERPRNVGSFDKSDPDVGTGLVGAPACGDVMKLQIKVDEQGNIVDARFKTFGCGSAIASSSVATEWVKGKSLDEVLKIKNSDIAKHLSLPPVKLHCSMLAEDAIKAAVKDIQAKRTKTATAAA

SEQ ID NO: 16377 - DNA, 728 bp, Anopheles gambiae str. PEST
  CDS (122)..(577)
ccacaccacaacgcaattgtttgtcgaggagtgcaatcgtgcttgtgcgttgaacctgcttgaggaaagtaacattgaaatcgtttgtgaatcgaaacactcaaccctcacaactatcatcatgtctctgccgcgcaacatcggcaccctgctgaaggtttcgcgtgcccgcagcgtaccggccgccctgtaccatcagaacgtgctggagcactacgaaaacccgcgcaacgtcggatcgctcgataagaaggacaagaacgtcggcaccgggctggtcggtgctccggcctgcggtgacgtgatgaagctgcagattaaggtggacgaaaatgggaagatcatcgacgccaagttcaagacgttcgggtgcggttcggccatcgcttccagctcgctggccaccgaatgggtgaagggcaagacgctcgaccaggctgggcagctgaaaaacacggacattgcgaaggagctgtcgctgccgccggtcaagctgcactgctcgatgctggcggaggacgccattaaggcggcgctggaggactacaacaagaaacagaagaagggtggcgagtaggccctctcggcggcatccatgcattcggttcggaggcggagatgattgtgtatgataaggaaggcgatgtattagtttgtatgtttggtgcaacttgctgtatgcttagtcaataaaactcatttattggtgttgaacaagtaaaacaaaa

SEQ ID NO: 16378 - protein, 151 aa, Anopheles gambiae str. PEST
MSLPRNIGTLLKVSRARSVPAALYHQNVLEHYENPRNVGSLDKKDKNVGTGLVGAPACGDVMKLQIKVDENGKIIDAKFKTFGCGSAIASSSLATEWVKGKTLDQAGQLKNTDIAKELSLPPVKLHCSMLAEDAIKAALEDYNKKQKKGGE

SEQ ID NO: 16379 - DNA, 923 bp, Apis mellifera
  CDS (203)..(700)
aatcgcgtaatttagttttgtgaagatgttttgtgtttttattttaattaaatacatataaggttgaaacaagagtaccatttttgaacattaccaacatttaaatcatatacttcaaggcaatatcgattgcttagtgaagtgttatgcataacgaacagattgcttcaagttactcaatgttaattcaaaaataaacacaatgtctttactgcaatcattgtcttcaggacttaacaaaacttcgaaattaatatctcgaagtgtcccagctgtattttatcatccaaatgtgatagatcactatgaaaatccaagaaatgtaggttctttggataaaaatgattctcaggttggtacaggtatcgtaggagccccagcctgtggagatgtaatgaaacttcaagttaaagttaatgagaaaggaaagattattgatgctaagtttaaaacttttggttgtggttctgctattgcttcaagttccttagccacagaatgggttaaaggaaaaactattgatgaagcactggctcttaagaatggagatattgctaaagaattgtgcttaccacctgtcaagttacattgttcaatgctcgcagaagatgcaattaaggctgctttgtcagattataatataaaacagaaacaaaaattgaaaaataatgataattataagaataaaaatgaaacatgattctgatatatttcagatgatagtaaaaaatattagaattatatatcttattttttgttttttgttcattaatttttatatataacaatattcataaattatgtgttgtgattagaatgaaaaagtgtatattaaattatatataaaatttaatgtaatacttgcatatattctttcattttttcaaaaaaaaaaataaatatatttaattaaacaattacag

SEQ ID NO: 16380 - protein, 165 aa, Apis mellifera
MSLLQSLSSGLNKTSKLISRSVPAVFYHPNVIDHYENPRNVGSLDKNDSQVGTGIVGAPACGDVMKLQVKVNEKGKIIDAKFKTFGCGSAIASSSLATEWVKGKTIDEALALKNGDIAKELCLPPVKLHCSMLAEDAIKAALSDYNIKQKQKLKNNDNYKNKNET

SEQ ID NO: 16381 - DNA, 522 bp, Aspergillus nidulans FGSC A4
  CDS (1)..(522)
atgtcgtcccccctgccatggtcagggcctaccatgagaaagatacgtagctctcctaacctcggctatggtctgaaagctaacctactcaaactgatcgatcactactcgaatcctcgcaatgtcggctctctgaaccgcaagtctctcgatgtaggtaccggcctcgtcggcgctccggcctgtggcgatgtcattcgtctcgacatccaggtggacgaggcgactggaaaaatcaccgagactcgtttcaagacttttggctgtggctcggccatcgctagttcaagctatctcaccaccctgctgaaggggaagaccttggaggaggcctccaagatttcaaacacccagattgcctctgaactctgcctgccccctgttaaactgcactgctccctccttgccgaagatgccgttaccgccgccatcaagaactaccgatcaaagagagccgccccggctaccgatctttccggaacggccaaggaaatccccaaggaagccgctgctactgcttaa

SEQ ID NO: 16382 - protein, 173 aa, Aspergillus nidulans FGSC A4
MSSPLPWSGPTMRKIRSSPNLGYGLKANLLKLIDHYSNPRNVGSLNRKSLDVGTGLVGAPACGDVIRLDIQVDEATGKITETRFKTFGCGSAIASSSYLTTLLKGKTLEEASKISNTQIASELCLPPVKLHCSLLAEDAVTAAIKNYRSKRAAPATDLSGTAKEIPKEAAATA

SEQ ID NO: 16383 - DNA, 627 bp, Ustilago maydis 521
  CDS (1)..(627)
atgttgcgaaactctatcattcccttcgcaaaacaggctgtagcctcgacttcgcgaacagctagcttctctacggtcgcacgacctgctgcagtcgccacagctcgcgcttccacttcttcgaatgtctttggtgctgctgttcagcgacgtggctaccacgaaaaggtcatcgatcactacgaaaacccacgcaatgttggatcgttcctcaaaaccgagaaaaacgttggtatcggtcttgtcggcgctcccgcgtgtggcgacgtcatgaaactctcgatcaaggtcaacgaagaagggatcatcgaggatgttcgtttcaagacgtttggctgtggttcggctatcgcttcgtcatcttacatgactgaacgtgtcaaaggtctctcccttgacgaagctgccaagatcaagaacaccgagattgctcaggagctctgccttccacccgtcaagcttcactgctccatgctcgctgaggatgccatcaagtcggccatcaagaactacaggtccaagcgcgaggcaacgggaaacaagaagcagggtcacattgaagttgttcaggatgtggctaccggcaacacttcggctaccgctcacgtaggctccggcaccgtttaa

SEQ ID NO: 16384 - protein, 208 aa, Ustilago maydis 521
MLRNSIIPFAKQAVASTSRTASFSTVARPAAVATARASTSSNVFGAAVQRRGYHEKVIDHYENPRNVGSFLKTEKNVGIGLVGAPACGDVMKLSIKVNEEGIIEDVRFKTFGCGSAIASSSYMTERVKGLSLDEAAKIKNTEIAQELCLPPVKLHCSMLAEDAIKSAIKNYRSKREATGNKKQGHIEVVQDVATGNTSATAHVGSGTV

SEQ ID NO: 16385 - DNA, 576 bp, Cryptococcus neoformans var. neoformans B-3501A
  CDS (1)..(576)
atgatgcgaaacactatcctccgatctaccgccgctatggcttccacctctttcgctcgacctgctgttcgagctcgacctgtactcgccgctgctcgaacgatgggtgccggcgctggtgtttccaagaggggataccacgccaaggtcattgaccactatgagaatcctcgtaacgttggcaaccttcccaagggtgactttgatgttggaactggtcttgttggtgcccccgcctgtggcgacgttatgaagcttcaaatccgagtaggcgaagacggtgtcatcagcgaagtcaagttcaagacgttcggttgtggttctgctatcgcctcatcgtcatatatgactgaacgagtaaagggcatgacccttgatcaggcgggtgcggtgaagaacactgagattgccaaggagctctgtcttcctcctgtaaagttgcactgctctctccttgcggaagatgctatcaagtctgccatcaaggactaccagaccaagcgagctcagcgacttgcatctaccaacgctactcttgcctcttcatcgtctcagcctcaacaggctgctgcgtaa

SEQ ID NO: 16386 - protein, 191 aa, Cryptococcus neoformans var. neoformans B-3501A
MMRNTILRSTAAMASTSFARPAVRARPVLAAARTMGAGAGVSKRGYHAKVIDHYENPRNVGNLPKGDFDVGTGLVGAPACGDVMKLQIRVGEDGVISEVKFKTFGCGSAIASSSYMTERVKGMTLDQAGAVKNTEIAKELCLPPVKLHCSLLAEDAIKSAIKDYQTKRAQRLASTNATLASSSSQPQQAAA

SEQ ID NO: 16387 - DNA, 564 bp, Candida albicans SC5314
  CDS (1)..(564): transl_table=12
atgtttaccagaacgattttacctactacaagaagaattttaactcaacaatcaagagttcttgttccaagattagctattccaacatcaacattcactagatcatatcatgaaaaagtcatagatcattatgaaaacccaagaaatgtgggctcgctcaataaagaatcttccgatgtcggtactggtttagttggtgctccagcttgtggagatgtgatgagattacaaatacaggttgatgaagaaacggggaaaatcaaggatgttaaattcaaaacattcggatgtgggtcggccatcgcttcttcatcatatgctacagaattgattagaggtaaaactcttgatgaagctttggatattaagaacactttaatcgctaaagagttgagcttgccaccagtcaaattacattgttctatgttggctgaagatgctatcaaggccgctgtcaaagactatcaatcaaagagaaaaacaactactttgggtgctactgctgcttcaactgtttcaagttcaagtgctagtgccgctgctcctgctactgctactgcttaa

SEQ ID NO: 16388 - protein, 187 aa, Candida albicans SC5314
MFTRTILPTTRRILTQQSRVLVPRLAIPTSTFTRSYHEKVIDHYENPRNVGSLNKESSDVGTGLVGAPACGDVMRLQIQVDEETGKIKDVKFKTFGCGSAIASSSYATELIRGKTLDEALDIKNTLIAKELSLPPVKLHCSMLAEDAIKAAVKDYQSKRKTTTLGATAASTVSSSSASAAAPATATA

SEQ ID NO: 16389 - DNA, 423 bp, Encephalitozoon cuniculi GB-M1
  CDS (1)..(423)
atgtctgcactccaggaactgagcggaataacagggaagtacgactcgagtgttgtggaccactttgaaaatccgagaaacgttgggtctcttgacaagacggatcctcgagtcggaactgggatggtcggggccccggcctgtggagacgtgatgaagcttcagataaaggtagggaaggataatgtgattgaggatgcaaagtttaagacctttggatgcgggtctgcaattgcatcgtcaagtctggcaacggagtggatcaagaagaagacaatagatgagtcattgaagatatccaatagagacatagcaaagaagctctccttaccaccgatcaagctccactgctccatgttggcagaagatgccatcaagatggcaatcaaagactttctggacaagaacaagccgtcaccatga

SEQ ID NO: 16390 - protein, 140 aa, Encephalitozoon cuniculi GB-M1
MSALQELSGITGKYDSSVVDHFENPRNVGSLDKTDPRVGTGMVGAPACGDVMKLQIKVGKDNVIEDAKFKTFGCGSAIASSSLATEWIKKKTIDESLKISNRDIAKKLSLPPIKLHCSMLAEDAIKMAIKDFLDKNKPSP

SEQ ID NO: 16391 - DNA, 585 bp, Tribolium castaneum
  CDS (23)..(478)
gtgatagcgcaagaattgaggcatggcgttgagctcctcctcaaaattgttgcgtgccgtggagccgctgagagtcctagcagctgcctaccaccctaaagtgatcgatcactacgaaaatccgcgcaatgtcggctcccttgacaagaacgacgagtccgtgggcacaggcctcgtgggggccccggcctgcggcgacgtcatgaagttgcaaatcaaggtggacgaaaatgggaaaatcatcgatgctaagttcaaaacatttggttgtgggtcagccattgcaagcagttctcttgctacagaatgggtaaagggtaagacagttgatcaagcccttgaactgaagaacacagatatcgcaaaagagttgtcgttgcctcccgtcaagttgcattgctctatgctggcggaagacgcgataaaagcggcattgtctgattacagaattaagcagaagaagaaggaagagaagtaaatggtcaacggatttaagggttgtgatatttaaattgtagtcggattaaaattaaaagctttaatgtgtaaatttgctaaatttaattaaagttataaataagtccc

SEQ ID NO: 16392 - protein, 151 aa, Tribolium castaneum
MALSSSSKLLRAVEPLRVLAAAYHPKVIDHYENPRNVGSLDKNDESVGTGLVGAPACGDVMKLQIKVDENGKIIDAKFKTFGCGSAIASSSLATEWVKGKTVDQALELKNTDIAKELSLPPVKLHCSMLAEDAIKAALSDYRIKQKKKEEK

SEQ ID NO: 16393 - DNA, 441 bp, Clostridium difficile 630
  CDS (1)..(441): transl_table=11
atgcaatatagtgataaagttatggaacattttatgaatccaagaaatatgggagaaattgataatgcaagtggtgtaggtgaagttggaaaccctacatgtggagatataatgaagatatttttagacatagatggagatgtaataaaggatgttaagtttaaaacatttggctgtggttcagctatagcaagttcttctatggcaactgaaatgataaaaggaaaaactataaaagatgcattagaacttacaaataaagctgttgcagaagctttggatggtttaccaccagtaaagatgcattgttcagttttagctgaacaagctgtaaaagcagctcttatagattatgctcaaaagaacaatatccatataccagaattggatggatatgttatagatgatgctcatgaccatgatgttgaagaagaagaataa

SEQ ID NO: 16394 - protein, 146 aa, Clostridium difficile 630
MQYSDKVMEHFMNPRNMGEIDNASGVGEVGNPTCGDIMKIFLDIDGDVIKDVKFKTFGCGSAIASSSMATEMIKGKTIKDALELTNKAVAEALDGLPPVKMHCSVLAEQAVKAALIDYAQKNNIHIPELDGYVIDDAHDHDVEEEE

SEQ ID NO: 16395 - DNA, 405 bp, Herminiimonas arsenicoxydans
  CDS (1)..(405)
atggcttactcagacaaagttctcgatcactacgaaaatccgcgcaacgtaggcgcgtttgacaagggtgatgaaacaatcggtaccggcatggtcggtgcgccggcttgcggcgacgtgatgaaattgcagatcaaggtcggcgccgatggcgtgatcgaggatgcaaaattcaaaacctacggttgcggttcggcgattgcatcgtcttcgctggtgactgaatgggtcaagggcaagacgctggatcaggcgctgtcgatcaagaatacgcaaattgccgaagagctggctttgccgccggtgaaaattcactgctcgattctggcagaagatgcgatcaaggcagccgtgctggattacaaaaccaagcatggcgtggcggaagctgaaaaagcagtttga

SEQ ID NO: 16396 - protein, 134 aa, Herminiimonas arsenicoxydans
MAYSDKVLDHYENPRNVGAFDKGDETIGTGMVGAPACGDVMKLQIKVGADGVIEDAKFKTYGCGSAIASSSLVTEWVKGKTLDQALSIKNTQIAEELALPPVKIHCSILAEDAIKAAVLDYKTKHGVAEAEKAV

SEQ ID NO: 16397 - DNA, 384 bp, Dehalococcoides sp. BAV1
  CDS (1)..(384): transl_table=11
atgactttgtactttgaaaaggttatggaatatttcgttaatcctcttaattcaggtgaaatggaaaatcctgacgggataggcagggccggcaatgccgtttgtggcgaggttactgaattttacataagggttaaagataaccgtttggtagaagttaagtttaaaacttatggctgcggggcggctgtagctatatccagtttggtaagcctgatggctaccggcaagacaattgaagaagccatgaagattgataacaaggcagtagaggctgaaataaagggcttgccccagaaccgtaaccattgttcccaaatgggtccacaggccttgcacagcgctattgccgactataaaatcaaagttcaggccagaggttaa

SEQ ID NO: 16398 - protein, 127 aa, Dehalococcoides sp. BAV1
MTLYFEKVMEYFVNPLNSGEMENPDGIGRAGNAVCGEVTEFYIRVKDNRLVEVKFKTYGCGAAVAISSLVSLMATGKTIEEAMKIDNKAVEAEIKGLPQNRNHCSQMGPQALHSAIADYKIKVQARG

SEQ ID NO: 16399 - DNA, 396 bp, Rickettsia akari str. Hartford
  CDS (1)..(396): transl_table=11
atggcttatagcacaaaagtgatagatcattatgaaaatcctcgtaatgtcgggtcacttgataaagagaaaaaaaatgtcggaacgggactagttggagctcctgcttgtggtgatgtaatgaagttacaaatcgaagttgatgatgacgggattattacagatgctaagtttaaaacattcggctgcggttcagctattgcttcaagttctttagtaacggaatgggttaaaggaagatcgataaatgatgctggagaaattaaaaatactgagatagcaaaagaattatcgctcccaccggtaaaattacattgctcactacttgctgaagatgcaataaaagcagctattgccgattacaaacagaaaaaagaaagcaaaaaagactcttaa

SEQ ID NO: 16400 - protein, 131 aa, Rickettsia akari str. Hartford
MAYSTKVIDHYENPRNVGSLDKEKKNVGTGLVGAPACGDVMKLQIEVDDDGIITDAKFKTFGCGSAIASSSLVTEWVKGRSINDAGEIKNTEIAKELSLPPVKLHCSLLAEDAIKAAIADYKQKKESKKDS

SEQ ID NO: 16401 - DNA, 522 bp, Desulfococcus oleovorans Hxd3
  CDS (1)..(522)
atgatatattcaaaaaccgtaatggaccattttcgaaacccccggaacgtgggggtaattgagaatgccgccggcgtgggcgaggtgggcaaccccatctgcggcgacatgatgaccatctacctggacatccaggacgaccgcatcgcggatatcaagtttcagacctttggctgcggttcggccattgccgtatccagcatgctcaccgagctggccaagggaaagacccttgaggaggccaagaagatcaccaacaaggatgtggctgaggcactggagggtctacccaaaaacaagctccactgctccaaccttggggccgacgcgctgcagatggccatcaaggactacgaggatagaaaagcgggcaaggtccggcctgagctcaagcgcaaggaatcccacgatgagctgcaccgggtgggcgacaagtgctactgcccctactgcgattcagaggtgtcggatggcgagaagatgtgcagcgcgtgtttgtccgacctgaccgaagaacattaa

SEQ ID NO: 16402 - protein, 173 aa, Desulfococcus oleovorans Hxd3
MIYSKTVMDHFRNPRNVGVIENAAGVGEVGNPICGDMMTIYLDIQDDRIADIKFQTFGCGSAIAVSSMLTELAKGKTLEEAKKITNKDVAEALEGLPKNKLHCSNLGADALQMAIKDYEDRKAGKVRPELKRKESHDELHRVGDKCYCPYCDSEVSDGEKMCSACLSDLTEEH

SEQ ID NO: 16403 - DNA, 417 bp, Thermus thermophilus HB27
  CDS (1)..(417): transl_table=11
atgagcgtccttgacgagctttaccgggaaatcctcctggaccactaccagagccccaggaacttcggggtcctgccccaggccaccaggcaggccggggggatgaacccctcctgcggggaccaggtggaggtgatggtgctcctagaaggggacaccatcgccgacatccgcttccaaggccaagggtgcgccatcagcacggcgagcgcctccctcatgaccgaggcggtgaagggcaaaaaggtggcggaggccctggagctttcccgcaagttccaggccatggtggtggagggcgcccccccggaccccaccttgggcgacctcctcgccctccaaggggtggccaagctccccgcccgggtgaagtgcgccaccctggcctggcacgccctggaggaggccctaaggtga

SEQ ID NO: 16404 - protein, 138 aa, Thermus thermophilus HB27
MSVLDELYREILLDHYQSPRNFGVLPQATRQAGGMNPSCGDQVEVMVLLEGDTIADIRFQGQGCAISTASASLMTEAVKGKKVAEALELSRKFQAMVVEGAPPDPTLGDLLALQGVAKLPARVKCATLAWHALEEALR

SEQ ID NO: 16405 - DNA, 387 bp, Acinetobacter sp. ADP1
  CDS (1)..(387): transl_table=11
atggcttatagcgaaaaggtaattgaccattacgaaaatccacgtaatgtcggtattttagataaaaatgctgaaaatgttggtacaggtatggtaggcgcgccagcgtgtggtgatgtcatgcgtttacaaatccaagtaaataatgatggtgtgatcgaagaagcacgtttcaaaacttatggttgtggctctgcgattgcttcaagttcattagtgacagaatggcttaaaggtaaaacacttgatcaagcgcaagcgatcaaaaatatcgacattgcaaatgaacttgctttgccacctgtgaaagtgcactgttctgtacttgcagaagatgccattaaagcggcgattgaagactatcgtaacaaacgatcaaaagcttaa

SEQ ID NO: 16406 - protein, 128 aa, Acinetobacter sp. ADP1
MAYSEKVIDHYENPRNVGILDKNAENVGTGMVGAPACGDVMRLQIQVNNDGVIEEARFKTYGCGSAIASSSLVTEWLKGKTLDQAQAIKNIDIANELALPPVKVHCSVLAEDAIKAAIEDYRNKRSKA

SEQ ID NO: 16407 - DNA, 396 bp, Rickettsia typhi str. Wilmington
  CDS (1)..(396): transl_table=11
atggcttataataaaaaagtgatagatcattatgaaaatcctcgtaatgttgggtcacttgataaaaacaaaaaaaatgttggtacagggcttgttggagctcctgcctgcggtgacgttatgaaattacaaatcgaagttgacgatgacgaaattattacagatgctaaatttaaaacatttggttgtggttcagctattgcttcaagttctctagtcacagagttggttaaaggaagatcagtagaagatgcacaagagattaaaaatactgaaatagcaaaagaattatctctgccgccggtaaaattacattgttcactcttggcagaagatgcaataaaagcagctattgccgattataaacagaaaaaaggaaacaaaaaagattcttaa

SEQ ID NO: 16408 - protein, 131 aa, Rickettsia typhi str. Wilmington
MAYNKKVIDHYENPRNVGSLDKNKKNVGTGLVGAPACGDVMKLQIEVDDDEIITDAKFKTFGCGSAIASSSLVTELVKGRSVEDAQEIKNTEIAKELSLPPVKLHCSLLAEDAIKAAIADYKQKKGNKKDS

SEQ ID NO: 16409 - DNA, 384 bp, Mannheimia succiniciproducens MBEL55E
  CDS (1)..(384): transl_table=11
atggcatatagcgaaaaagttatcgatcattatgagaaccctcgcaacgtaggttcttttgataaaaaatcatcagatgtgggcaccggaatggtgggcgcaccggcttgcggtgatgttatgcagttacaaattaaagtaaatgaagaaggtattattgaagatgcaaaattcaaaacatacggttgcggctctgccattgcatcaagctcattgattaccgaatgggtgaagggcaaatctttagatgaagccggcgcgattaaaaacagccagattgcagaagaactggaattaccgccggttaaagtgcattgctcaattctggcggaagatgcaattaaagcggcaattgccgattataaatctaaaaaaggcgcataa

SEQ ID NO: 16410 - protein, 127 aa, Mannheimia succiniciproducens MBEL55E
MAYSEKVIDHYENPRNVGSFDKKSSDVGTGMVGAPACGDVMQLQIKVNEEGIIEDAKFKTYGCGSAIASSSLITEWVKGKSLDEAGAIKNSQIAEELELPPVKVHCSILAEDAIKAAIADYKSKKGA

SEQ ID NO: 16411 - DNA, 420 bp, Methylococcus capsulatus str. Bath
  CDS (1)..(420): transl_table=11
atggcatacagcgataaagtcatcgaccactacgaaaatccccgcaacgtcggctccttcgacaaggacgaagacggcgtgggcaccggcgtcgtcggcgctccggcctgcggcgacgtgatgaagctgcagatcaagatcaatgaggaaggcgtgatcgaggatgccaaattcaagacctatggctgcggttcggcgatcgcctccagctcgctggtgaccgagtgggtcaagggcaagaccgtcgacgaggccctggccatcaagaactccgacatcgccgaggcattggcgctgccaccggtgaagatccactgctccgtgctggccgaagacgccatcaaggccgccgtctcggactacaaggccaaactgggcgtggccgatgatggctacgaaattcgcaaatcggccgcctga

SEQ ID NO: 16412 - protein, 139 aa, Methylococcus capsulatus str. Bath
MAYSDKVIDHYENPRNVGSFDKDEDGVGTGVVGAPACGDVMKLQIKINEEGVIEDAKFKTYGCGSAIASSSLVTEWVKGKTVDEALAIKNSDIAEALALPPVKIHCSVLAEDAIKAAVSDYKAKLGVADDGYEIRKSAA

SEQ ID NO: 16413 - DNA, 384 bp, Dehalococcoides ethenogenes 195
  CDS (1)..(384): transl_table=11
atggctttttactttgaaaaggtgatggaatactttgtgaatcctcttaattcgggtgaaatggaaaatcctgacggcataggcagagccggaaatgacatttgcggagatgttaccgaattttacataagggtaaaagataaccgtctggtggaagtgaaatttaaaacttacggctgcggggcagctgtggctatatccagtctggtaagcctgatggctaccgataaaacaattgaagaagctatgaaaattgataacaaggcagtagaggctgagattaaggggctgccgcagaaccgcagccattgttcccagatgggcccccaggccctgcacagcgctattgctgattataaaagcaaagttcaggccagaggttaa

SEQ ID NO: 16414 - protein, 127 aa, Dehalococcoides ethenogenes 195
MAFYFEKVMEYFVNPLNSGEMENPDGIGRAGNDICGDVTEFYIRVKDNRLVEVKFKTYGCGAAVAISSLVSLMATDKTIEEAMKIDNKAVEAEIKGLPQNRSHCSQMGPQALHSAIADYKSKVQARG

SEQ ID NO: 16415 - DNA, 414 bp, Ehrlichia ruminantium str. Welgevonden
  CDS (1)..(414): transl_table=11
atgagttacagtgaatctcttctagaacattataagaatcctaaaaatgttggtactttacctaaagaggattacaatgtaggtactggcttagtgggagctcctagctgtggtgatgtaatgaagttacagattaaagtagatgataatggaaaaattatagatgcaaagtttaaaacttttggatgtggtgctgcaattgcagctagttcactagctactgagttaattaaaggtaaaacagtagatgaggcacatgagttgaaaaatacagtattggcaaaagaattaagtttacccccagtgaaaatacattgttcattacttgcagaagatgctgtaaaagcagctataaatgactatcatatgaaacaagcaaacaaaaaaaatgctactaaaaatcctaatgaataa

SEQ ID NO: 16416 - protein, 137 aa, Ehrlichia ruminantium str. Welgevonden
MSYSESLLEHYKNPKNVGTLPKEDYNVGTGLVGAPSCGDVMKLQIKVDDNGKIIDAKFKTFGCGAAIAASSLATELIKGKTVDEAHELKNTVLAKELSLPPVKIHCSLLAEDAVKAAINDYHMKQANKKNATKNPNE

SEQ ID NO: 16417 - DNA, 387 bp, Psychrobacter arcticus 273-4
  CDS (1)..(387): transl_table=11
atggcctatagtgaccaagttattgatcattacgaaaatccacgcaacgttggcaatcttgataaaaatgccaaaaacgtcggcactggcatggtcggcgcaccagcctgtggtgatgtcatgcgtttacaaatccaagtcgatgataacggtattatcgaagatgcacgttttaaaacttatggttgtggttcagccattgcttcaagctcgctcgttactgagtggctaaaaggcaaaagcttggatcaagctggcgaaattaagaatagtgacattgctgaagaattggcattaccaccagtaaaagtgcattgctctgtccttgcagaagatgctatcaaagccgctattagcgactataaaggtaagcatattcctgcttga

SEQ ID NO: 16418 - protein, 128 aa, Psychrobacter arcticus 273-4
MAYSDQVIDHYENPRNVGNLDKNAKNVGTGMVGAPACGDVMRLQIQVDDNGIIEDARFKTYGCGSAIASSSLVTEWLKGKSLDQAGEIKNSDIAEELALPPVKVHCSVLAEDAIKAAISDYKGKHIPA

SEQ ID NO: 16419 - DNA, 384 bp, Colwellia psychrerythraea 34H
  CDS (1)..(384): transl_table=11
atggcttacagcgaaaaagtactagatcattatgagaacccacgtaacgtaggttcaatggataaaaacgatccatcagtagcaactggtatggttggcgcaccagcgtgtggtgacgtaatgaagttacaactaaaaatttctgatgacggtatcattgaagatgcaaaattcaagacttacggttgtggttctgcgattgcttcaagctcattagttactgagtgggttaaaggtaaatcaattgaagaagcgggtgaaattaaaaataccgctattgctgaagagttagcgctaccaccagtaaaaattcattgctctattttagctgaagatgctattaaagcagcgattgaagattataaatccaagcaaagtaaataa

SEQ ID NO: 16420 - protein, 127 aa, Colwellia psychrerythraea 34H
MAYSEKVLDHYENPRNVGSMDKNDPSVATGMVGAPACGDVMKLQLKISDDGIIEDAKFKTYGCGSAIASSSLVTEWVKGKSIEEAGEIKNTAIAEELALPPVKIHCSILAEDAIKAAIEDYKSKQSK

SEQ ID NO: 16421 - DNA, 387 bp, Pseudomonas syringae pv. phaseolicola 1448A
  CDS (1)..(387): transl_table=11
atggcttacagcgaaaaggtcatcgaccactacgagaacccacgtaacgtcggcaagatgaacgcggaagatcctgatgtcggcaccggcatggtcggcgctccagcgtgcggcgacgtaatgcgtttgcagatcaaggttaacgagcagggcgttatcgaagacgccaagttcaagacctacggctgcggttcggccattgcttccagttcgctggcgaccgagtggatgaaaggcaagactctggatgaagcagagaccatcaagaacactcagctggctgaagagctggcgctgccgccggtcaagattcactgctcggtactcgctgaagacgccatcaaggccgccgttcgcgattacaagcagaagaaaggtctgctgtaa

SEQ ID NO: 16422 - protein, 128 aa, Pseudomonas syringae pv. phaseolicola 1448A
MAYSEKVIDHYENPRNVGKMNAEDPDVGTGMVGAPACGDVMRLQIKVNEQGVIEDAKFKTYGCGSAIASSSLATEWMKGKTLDEAETIKNTQLAEELALPPVKIHCSVLAEDAIKAAVRDYKQKKGLL

SEQ ID NO: 16423 - DNA, 384 bp, Dechloromonas aromatica RCB
  CDS (1)..(384): transl_table=11
atgagctatagcgtaaaagtcattgatcactatgaaaatccacgtaacgtcggttcctttgccaaggaagatgatggcgttggtaccggcatggttggcgcgccggcctgcggcgacgtgatgaagctgcagattaaggtgaacaagtccggcgtgattgaagatgccaagttcaagacctatggctgcggttccgccattgcctcttcttcgctggtcaccgaatgggtcaagggcaagacggtcgatcaggctttgtcgatcaaaaataccgaaattgctgaagaactggccctgccgccggttaaaattcactgttcgattctggccgaggatgccatcaaggcagccgtggcggattacaagaaaaagcacggagaataa

SEQ ID NO: 16424 - protein, 127 aa, Dechloromonas aromatica RCB
MSYSVKVIDHYENPRNVGSFAKEDDGVGTGMVGAPACGDVMKLQIKVNKSGVIEDAKFKTYGCGSAIASSSLVTEWVKGKTVDQALSIKNTEIAEELALPPVKIHCSILAEDAIKAAVADYKKKHGE

SEQ ID NO: 16425 - DNA, 402 bp, Ralstonia eutropha JMP134
  CDS (1)..(402): transl_table=11
atgtcatacagcacgaaggttctcgaccactatgaaaacccccgcaatgtcggttcgttcgacaagaacgacgacgatgtgggtaccggcatggtcggcgccccggcttgcggcgacgtgatgaagctgcagatcaaggtgaacgaggccggcgtgatcgaagacgccaagttcaagacctatggctgcggctcggccatcgcgtcgtcgtcgctcgtgaccgagtgggtcaagggcaagaccgtcgaccaggccctcgagatcaagaacacccagatcgccgaagaactggcgctgccgccggtcaagatccactgctcgatcctcgctgaggacgccatcaaggcggctgtcgaggactacaagaagaagcacccggcagctgaccagaaggccgcctga

SEQ ID NO: 16426 - protein, 133 aa, Ralstonia eutropha JMP134
MSYSTKVLDHYENPRNVGSFDKNDDDVGTGMVGAPACGDVMKLQIKVNEAGVIEDAKFKTYGCGSAIASSSLVTEWVKGKTVDQALEIKNTQIAEELALPPVKIHCSILAEDAIKAAVEDYKKKHPAADQKAA

SEQ ID NO: 16427 - DNA, 417 bp, Ehrlichia canis str. Jake
  CDS (1)..(417): transl_table=11
atgagttatagtgaagttctattagaacattataaaaatcccaaaaacgttggcactctaccaaaagatgattacaatgttggtactgggttagtaggagctccaagctgtggagacgtaatgaaattacaaataaaagtagataataacggaagaatcattgatgcaaaatttaaaacttttggatgtggagctgcaattgcagcaagttctctagcaacagagctaataaaaggtaaaacagtagatgaagcacatcaattaaaaaacacagtattagcaaaagaattaagtttaccaccagtaaaaatacattgttcattacttgcagaagacgctataaaagctgcaataaatgattacaatatgaaacaagaaaatagaaaaagtaatactgcattttcaagtgatgaataa

SEQ ID NO: 16428 - protein, 138 aa, Ehrlichia canis str. Jake
MSYSEVLLEHYKNPKNVGTLPKDDYNVGTGLVGAPSCGDVMKLQIKVDNNGRIIDAKFKTFGCGAAIAASSLATELIKGKTVDEAHQLKNTVLAKELSLPPVKIHCSLLAEDAIKAAINDYNMKQENRKSNTAFSSDE

SEQ ID NO: 16429 - DNA, 390 bp, Methanosarcina barkeri str. Fusaro
  CDS (1)..(390): transl_table=11
atggattacagccttaaagtaatggaccacttttcaaatccaagaaacatgggaagcattgagaacagtgatggtgtaggagaagttgggaatgcgaagtgcggagatataatgaaaatctacctcaaggttgaggataatcggattgcggacgtgaagttccagaccttcggatgcggagctgcaatcgcatcaagcagtatggcaaccgaaatgattaaaggaaaaacccttgaagaagcctggaaactttcaaacaaagccgttgcagaagcccttgatggacttcccccaataaaaatgcactgttcaatgcttgcagaagaggcgatccatgaagcaattaacgattatctaaagaaaaaaggacttgagccgtggacagaataa

SEQ ID NO: 16430 - protein, 129 aa, Methanosarcina barkeri str. Fusaro
MDYSLKVMDHFSNPRNMGSIENSDGVGEVGNAKCGDIMKIYLKVEDNRIADVKFQTFGCGAAIASSSMATEMIKGKTLEEAWKLSNKAVAEALDGLPPIKMHCSMLAEEAIHEAINDYLKKKGLEPWTE

SEQ ID NO: 16431 - DNA, 390 bp, Methanosarcina barkeri str. Fusaro
  CDS (1)..(390): transl_table=11
atgtataataaaaaagtcatggatcacttcatgaacccaagaaacgtaggggaaattgaagatgctaacggggtcggagaagcaggaaatccacatggagactacatgaagatcttcctgaaaattcgggacgatcgagttgaagatgcgaagtttaagaccttcgggtgtgcagcagcaattgcgtccagtagcatggcaaccgaactgataaaaggcaaaaccctcaaagaagcctgggaacttacaaacgaggacgtagctgaggctcttgaaggcctgcctccaggcaagctggaatgttcggttctttcaagggaagcaatccacagcgcaataaatgaataccgaagaaaacaggggcttggggctcttcctgaacagacctga

SEQ ID NO: 16432 - protein, 129 aa, Methanosarcina barkeri str. Fusaro
MYNKKVMDHFMNPRNVGEIEDANGVGEAGNPHGDYMKIFLKIRDDRVEDAKFKTFGCAAAIASSSMATELIKGKTLKEAWELTNEDVAEALEGLPPGKLECSVLSREAIHSAINEYRRKQGLGALPEQT

SEQ ID NO: 16433 - DNA, 384 bp, Dehalococcoides sp. CBDB1
  CDS (1)..(384): transl_table=11
atgactttgtactttgaaaaggttatggaatatttcgttaatcctcttaattcaggtgaaatggaaaatcctgacgggataggcagggccggcaatgccgtttgtggcgatgttactgaattttacataagggttaaagataaccgtttggtagaagttaagtttaaaacttatggctgcggggcggctgtagctatatccagtttggtaagcctgatggctaccggcaagacaattgaagaagccatgaagattgataacaaggcagtagaggctgaaataaaggggttgccccagaaccgtaaccattgttcccaaatggggccacaagccttgcacagcgctattgccgactataaaatcaaagttcaggccagaggttaa

SEQ ID NO: 16434 - protein, 127 aa, Dehalococcoides sp. CBDB1
MTLYFEKVMEYFVNPLNSGEMENPDGIGRAGNAVCGDVTEFYIRVKDNRLVEVKFKTYGCGAAVAISSLVSLMATGKTIEEAMKIDNKAVEAEIKGLPQNRNHCSQMGPQALHSAIADYKIKVQARG

SEQ ID NO: 16435 - DNA, 387 bp, Thiobacillus denitrificans ATCC 25259
  CDS (1)..(387): transl_table=11
atgtcatacagcgacaaggtactcgaccactacgaaaacccgcgcaacgtcggcgctttcaacaaggaagacgaaggcgtcgggaccggcatggtcggcgcgcccgcgtgcggcgacgtcatgaagctgcagatcaaggtcggcaaggacggcttgatcgaagacgcgaagttcaagacctacggctgcggatcggcgatcgcctcgtcgtcgctcgtgaccgagtgggtcaagggcaagacgctcgatcaggcgatggaaatcaagaacacggcgatcgcggaagaactcgcgctgccgccggtgaagatccactgctcgattctcgccgaagacgcgatcaaggcggctgtcgccgactacaagcagaagaagggtctggagtaa

SEQ ID NO: 16436 - protein, 128 aa, Thiobacillus denitrificans ATCC 25259
MSYSDKVLDHYENPRNVGAFNKEDEGVGTGMVGAPACGDVMKLQIKVGKDGLIEDAKFKTYGCGSAIASSSLVTEWVKGKTLDQAMEIKNTAIAEELALPPVKIHCSILAEDAIKAAVADYKQKKGLE

SEQ ID NO: 16437 - DNA, 387 bp, Pseudomonas fluorescens PfO-1
  CDS (1)..(387): transl_table=11
atggcttacagcgaaaaggtcatcgaccactacgaaaacccgcgcaacgtcggcaagatgaacgcggaagatcctgatgtcggcactggcatggtcggcgctccggcgtgcggcgacgtgatgcgtctgcaaatcaaggtcaacgatcagggcgttatcgaagacgccaagttcaagacctacggctgcggttcggctatcgcctccagctccctcgctaccgagtggatgaagggcaagactctggacgaagctgaaaccatcaagaacactcagctggccgaagaactggctctgccgccagtgaaaatccactgctcggttctcgctgaagacgctatcaaagcggccgttcgcgattacaagcagaagaaaggcttgatctga

SEQ ID NO: 16438 - protein, 128 aa, Pseudomonas fluorescens PfO-1
MAYSEKVIDHYENPRNVGKMNAEDPDVGTGMVGAPACGDVMRLQIKVNDQGVIEDAKFKTYGCGSAIASSSLATEWMKGKTLDEAETIKNTQLAEELALPPVKIHCSVLAEDAIKAAVRDYKQKKGLI

SEQ ID NO: 16439 - DNA, 378 bp, Carboxydothermus hydrogenoformans Z-2901
  CDS (1)..(378): transl_table=11
atgatgtatagcgaaaaagttatggaccatttcaccaatccgcgaaatgtgggggaaatccccgatgctgatggagtcggggaagtaggtaatccttcctgcggcgacatcatgcggatttacattaaagtagatggtgataaaattaccgatgtaaaatttaaaacttttggctgcggggcagctatcgctaccagttctatggtgaccgaaatggtaaaagggaagactatcgaagaagcaatgaagattaccaacaaagctgtggccgatgctttggatggactaccaccgcaaaaaatgcactgttccaatttagctgccgatgccttaaaagttgctatcgaggattacttaaagaaaaaagggcaaaaataa

SEQ ID NO: 16440 - protein, 125 aa, Carboxydothermus hydrogenoformans Z-2901
MMYSEKVMDHFTNPRNVGEIPDADGVGEVGNPSCGDIMRIYIKVDGDKITDVKFKTFGCGAAIATSSMVTEMVKGKTIEEAMKITNKAVADALDGLPPQKMHCSNLAADALKVAIEDYLKKKGQK

SEQ ID NO: 16441 - DNA, 408 bp, Burkholderia sp. 383
  CDS (1)..(408): transl_table=11
atgtcttacagcaacaaggttctggatcactacgaaaacccgcgcaacgtcggttcgttcgcgaaggacgacgacacggtcggcacgggcatggtcggcgcgccggcctgcggcgacgtgatgaagctgcagatccgcgtcggcgcggacggcgtgatcgaagacgcgaagttcaagacctacggttgcggttcggcgatcgcgtcgagctcgctcgtcaccgaatgggtgaagggcaagacgctcgatgaagccctgtcgatcaagaacacgcagatcgcggaagaactcgcgctgccgccggtgaagattcactgctcgatcctcgcggaagacgcgatcaaggcagccgtggccgactacaagaagcgtcacgacaccacggaaggcgatcaggcagcagcctga

SEQ ID NO: 16442 - protein, 135 aa, Burkholderia sp. 383
MSYSNKVLDHYENPRNVGSFAKDDDTVGTGMVGAPACGDVMKLQIRVGADGVIEDAKFKTYGCGSAIASSSLVTEWVKGKTLDEALSIKNTQIAEELALPPVKIHCSILAEDAIKAAVADYKKRHDTTEGDQAAA

SEQ ID NO: 16443 - DNA, 378 bp, Moorella thermoacetica ATCC 39073
  CDS (1)..(378): transl_table=11
atgtactcggaaaaagtcatggatcatttcaccaatccccgcaacgtcggtgagattgagaatgccgacggggtcggccaggtaggcaatcccgtctgtggcgatattatgcgcctatatatcaaagtcgaagacggtattatcaaggatgtcaaatttaaaaccttcggctgcggggctgccattgccaccagcagtatggtcacagaaatggtcaagggcaagaccgtggaagaggccctcaaaatcagcaacgcggccgtggccgaggccctggacgggcttccgccccagaagatgcactgttccaacctggccgccgatgccctgcataaagccatcgaggattaccagaatagaaataagaaagcctcctaa

SEQ ID NO: 16444 - protein, 125 aa, Moorella thermoacetica ATCC 39073
MYSEKVMDHFTNPRNVGEIENADGVGQVGNPVCGDIMRLYIKVEDGIIKDVKFKTFGCGAAIATSSMVTEMVKGKTVEEALKISNAAVAEALDGLPPQKMHCSNLAADALHKAIEDYQNRNKKAS

SEQ ID NO: 16445 - DNA, 408 bp, Burkholderia thailandensis E264
  CDS (1)..(408): transl_table=11
atgtcatacagcaacaaggttctggatcactacgaaaatccgcgtaacgtcggctcgttcgcgaaggacgacgacgcggtgggcaccggcatggtcggcgcgcccgcgtgcggcgacgtgatgaagctgcagatccgcgtcggcgagaacggcgtgatcgaagacgcgaagttcaagacctacggttgcgggtcggcgatcgcgtcgagctcgctcgtcaccgagtgggtgaagggcaagacgctcgacgaggcgctcgcgatcaagaacacgcagatcgccgaggaactcgcgctgccgcccgtgaagatccactgctcgatcctcgcggaagacgcgatcaaggcggccgtggccgactacaagaagcgccacgaaacggccgaagacggcaaggccgccgcgtaa

SEQ ID NO: 16446 - protein, 135 aa, Burkholderia thailandensis E264
MSYSNKVLDHYENPRNVGSFAKDDDAVGTGMVGAPACGDVMKLQIRVGENGVIEDAKFKTYGCGSAIASSSLVTEWVKGKTLDEALAIKNTQIAEELALPPVKIHCSILAEDAIKAAVADYKKRHETAEDGKAAA

SEQ ID NO: 16447 - DNA, 393 bp, Anaplasma phagocytophilum HZ
  CDS (1)..(393): transl_table=11
atgagttatagtgatgctgtattaaatcgctgcaaggctcctcagaatgtgggttcgctacctaaggatgatatttctgttggtacgggcttggtgggtgcgccgagttgtggtgacgtgatgaagttgcaaattagggtggacgagaacgggaagatagtcgatgccaagttcaagacctttggatgtggagcagcaatagcagcgagtgaattggctactgagaggataatgggtaagactatagacgaggcatctttgttgaagaatactgttcttgctaaggagctttctcttcctccggtaaagatacattgctctatattggctgaagatgctgtgaaggctgctattaatgattatcgtaaaaagcaagaagcggtaggcaattaa

SEQ ID NO: 16448 - protein, 130 aa, Anaplasma phagocytophilum HZ
MSYSDAVLNRCKAPQNVGSLPKDDISVGTGLVGAPSCGDVMKLQIRVDENGKIVDAKFKTFGCGAAIAASELATERIMGKTIDEASLLKNTVLAKELSLPPVKIHCSILAEDAVKAAINDYRKKQEAVGN

SEQ ID NO: 16449 - DNA, 429 bp, Neorickettsia sennetsu str. Miyayama
  CDS (1)..(429): transl_table=11
atggcttatagtgattccgtattaaatcattacaacaatccaagaaatgttggtacaattgacaagaacaaaaaaaatgtaggaaccggcttagtgggtgctccagcctgcggggatgtaatgagattacagatcgaagttgataataacggttgcattgtagacgcaaagttcaaaacctttggttgtggttcagcgatagcatcaagctccttagcaacagagtacctgatcgggaaaagcatcgaggaagccgaaaaaatcaagaatactgagatcgcatctactttgtgtctcccaccgataaaaatgcactgctcaatgctggcagaggatgcaatcaaagctgctatcaaagattttagagagaaacaggtgacttctagcactgaggaggcaggtaacgaaaatacagagaacaaaagctaa

SEQ ID NO: 16450 - protein, 142 aa, Neorickettsia sennetsu str. Miyayama
MAYSDSVLNHYNNPRNVGTIDKNKKNVGTGLVGAPACGDVMRLQIEVDNNGCIVDAKFKTFGCGSAIASSSLATEYLIGKSIEEAEKIKNTEIASTLCLPPIKMHCSMLAEDAIKAAIKDFREKQVTSSTEEAGNENTENKS

SEQ ID NO: 16451 - DNA, 414 bp, Ehrlichia chaffeensis str. Arkansas
  CDS (1)..(414): transl_table=11
atgagttatagtgaatctcttctagagcattacaaaaatcctaaaaacgtcggtactctacctaaagaagattataatgtaggaactggactagtaggagctccaagctgtggagatgtaatgaagttacaaataaaagtagatgataatggtaaaatcattgatgcaaagtttaaaactttcggatgtggagccgcaattgcagcaagttctttagcaacagagctaataaaaggtaagacaatagatgaagcacatcaattaaaaaatactgttttagcaaaagaattaagcctgcctccagtaaagatacattgttctttacttgcagaagatgctgtaaaagctgccataaaggattataacatgaagcaagcaaccaaaaaagacaagctttcatcttcaaatgaatag

SEQ ID NO: 16452 - protein, 137 aa, Ehrlichia chaffeensis str. Arkansas
MSYSESLLEHYKNPKNVGTLPKEDYNVGTGLVGAPSCGDVMKLQIKVDDNGKIIDAKFKTFGCGAAIAASSLATELIKGKTIDEAHQLKNTVLAKELSLPPVKIHCSLLAEDAVKAAIKDYNMKQATKKDKLSSSNE

SEQ ID NO: 16453 - DNA, 384 bp, Desulfitobacterium hafniense Y51
  CDS (1)..(384)
atgagcgatatgtatacagaaaaagtaatggatcattttatgaatccccgcaatgtgggtgagattgaggatgctaacggtgtcggcgaagtaggcaacgctaaatgcggcgatattatgcgtatctatttggatgttgaaggcgatattattaaagacgttaagttcaagacctttggctgcggagccgcggtagccaccagcagtatggttacggaaatggtcaagggcaagagcatagatgaggctcttcaaatcaccaatgcggctgttgccgaggccctggacggacttcccccggctaagatgcactgttccaacctggctgccgatgccttgcacgaggccatcaaggattataaagagaaaactctgaaagtataa

SEQ ID NO: 16454 - protein, 127 aa, Desulfitobacterium hafniense Y51
MSDMYTEKVMDHFMNPRNVGEIEDANGVGEVGNAKCGDIMRIYLDVEGDIIKDVKFKTFGCGAAVATSSMVTEMVKGKSIDEALQITNAAVAEALDGLPPAKMHCSNLAADALHEAIKDYKEKTLKV

SEQ ID NO: 16455 - DNA, 402 bp, Methylobacillus flagellatus KT
  CDS (1)..(402): transl_table=11
atggcttattcggacaaagtactcgaccattatgaaaacccacgtaacgtaggctcactggacaagaacgatccctctgtcggtaccggcatggtgggtgctcctgcctgtggggacgtgatgaagctgcaaatcaaggtcaatgaccagggcattattgaagacgccaagttcaagacttacggttgcggctctgccattgcatccagctcactggtgactgaactgattaagggcaagtcccttgaccaggccatggaaatcaagaattccgatattgcccaggaactggcgctgcctccagtcaaaatccactgctcggtactggctgaagacgccatccgtgcagcggtggccgatctcaaagccaagcagggcgccaaggatcaacaggtggcataa

SEQ ID NO: 16456 - protein, 133 aa, Methylobacillus flagellatus KT
MAYSDKVLDHYENPRNVGSLDKNDPSVGTGMVGAPACGDVMKLQIKVNDQGIIEDAKFKTYGCGSAIASSSLVTELIKGKSLDQAMEIKNSDIAQELALPPVKIHCSVLAEDAIRAAVADLKAKQGAKDQQVA

SEQ ID NO: 16457 - DNA, 447 bp, Burkholderia xenovorans LB400
  CDS (1)..(447): transl_table=11
atggcatacagcgacaaggtcatcgatcactacgagaacccccgcaacgtcggcgcgttcgatccggacgccgcgaacgtcggcaccggcatggtcggcgcgccggcatgcggcgacgtgatgcggttgcagattcgcgtcaaccgcgaaggcgtgatcgaagatgcgaagttcaagacctacggctgcggctcggcgatcgcctccagttcgctcgtcaccgaatgggtgcgcggccgcacgctcgacgaagcgctcgcgatcaggaacacgcagatcgccgaggaactggcgctgccgccggtcaagatccactgctcgattctcgccgaagacgcgatcaaggccgccgtggccgacttccgttcacgccaggcgattcagggcactgccgccgacagcctgcaactcgccgaccaaccggtctgctcgtccaatccgaactga

SEQ ID NO: 16458 - protein, 148 aa, Burkholderia xenovorans LB400
MAYSDKVIDHYENPRNVGAFDPDAANVGTGMVGAPACGDVMRLQIRVNREGVIEDAKFKTYGCGSAIASSSLVTEWVRGRTLDEALAIRNTQIAEELALPPVKIHCSILAEDAIKAAVADFRSRQAIQGTAADSLQLADQPVCSSNPN

SEQ ID NO: 16459 - DNA, 414 bp, Burkholderia xenovorans LB400
  CDS (1)..(414): transl_table=11
atggcttatagcgacaaggttctggaccactacgaaaacccgcgcaacgtcggttccttcgcgaaggacgacgatgcggtcggcaccggcatggtcggcgcgccggcctgcggcgacgtgatgaagctgcagatccgcgtgggcgcggacggcatcatcgaggacgcgaagttcaagacgtatggctgcggctcggcgatcgcgtcgagctcgctcgtcaccgaatgggtgaagggcaagacgctcgatcaggccatgtcgatcaagaacacgcagatcgccgaagaactggcactgccgccggtcaagatccactgctcgatcctcgcggaagacgcgatcaaggcagcggtcgccgactacaagcaacgccacggtgaagcggtcgtcgcagacgaaaagcagcacgcctga

SEQ ID NO: 16460 - protein, 137 aa, Burkholderia xenovorans LB400
MAYSDKVLDHYENPRNVGSFAKDDDAVGTGMVGAPACGDVMKLQIRVGADGIIEDAKFKTYGCGSAIASSSLVTEWVKGKTLDQAMSIKNTQIAEELALPPVKIHCSILAEDAIKAAVADYKQRHGEAVVADEKQHA

SEQ ID NO: 16461 - DNA, 402 bp, Ralstonia metallidurans CH34
  CDS (1)..(402): transl_table=11
atgtcttacagcaacaaggttctcgaccactatgaaaatccgcgtaacgtcggttcgttcgacaagaacgacgacgcggtgggtaccggcatggtcggcgccccggcctgcggcgacgtgatgaagctgcagatcaaggtgaacgaggcgggcgtgatcgaggacgccaagttcaagacctatggttgtggttcggcgatcgcctcgtcgtcgctggtgaccgagtgggtcaagggcaagaccgtggaccaggcgctggagatcaagaacacccagatcgccgaggaactggctctgccgccggtgaagatccactgctcgatcctcgccgaggacgccatcaaggcggccgtcgatgattacaagaagaagcacccgggcgccgagcagaaggctgcctga

SEQ ID NO: 16462 - protein, 133 aa, Ralstonia metallidurans CH34
MSYSNKVLDHYENPRNVGSFDKNDDAVGTGMVGAPACGDVMKLQIKVNEAGVIEDAKFKTYGCGSAIASSSLVTEWVKGKTVDQALEIKNTQIAEELALPPVKIHCSILAEDAIKAAVDDYKKKHPGAEQKAA

SEQ ID NO: 16463 - DNA, 387 bp, Acidobacteria bacterium Ellin345
  CDS (1)..(387): transl_table=11
atggcatacagcgagaaggttctagatcattattcgaatccgcggaatgtgggttctatggacaagaacagcgccgaagttggaactgggctggtaggcgcgcctgagtgtggcgacgtgatgaagctgcaaatcaaggtgaatcctgagaccaacatcattgaggacgcgaagttcaagacgttcggatgcgggtcggcgattgcatcgtcttcgctggccacggagtgggtgaagggcaagaccgtggatgaagcgctcgggattaagaacacggacattgtgaaggagctttcacttcctccggtgaagatccactgttcggtattggcggaagacgcgatccgggcggcgattggcgactggaagaagaagaacaaccagtag

SEQ ID NO: 16464 - protein, 128 aa, Acidobacteria bacterium Ellin345
MAYSEKVLDHYSNPRNVGSMDKNSAEVGTGLVGAPECGDVMKLQIKVNPETNIIEDAKFKTFGCGSAIASSSLATEWVKGKTVDEALGIKNTDIVKELSLPPVKIHCSVLAEDAIRAAIGDWKKKNNQ

SEQ ID NO: 16465 - DNA, 402 bp, Myxococcus xanthus DK 1622
  CDS (1)..(402): transl_table=11
atggcttacagcgacaaggtcatcgagcactacgagaacccccggaacgtcgggacgctcgacaaggaagacccgaacgtgggcaccggcctggtgggcgcgcccgcctgcggcgacgtgatgcgcctgcagctcaagatttccgaggacgggctcatcgaggacgcccgcttcaagacgttcggctgcgggtcggccattgcctcgtcgtcgctcgtcaccgaatgggtgaagggcaagacggtggaccaggcgatgaccatctccaacaaggacgtggcccgcgagctgtcgctgccgccggtgaagattcactgctccgtgctggccgaggacgccatcaaggcggccatcgaggacttcaagaagaagcgcgccgcgcgtcaggccaaggcgtcctga

SEQ ID NO: 16466 - protein, 133 aa, Myxococcus xanthus DK 1622
MAYSDKVIEHYENPRNVGTLDKEDPNVGTGLVGAPACGDVMRLQLKISEDGLIEDARFKTFGCGSAIASSSLVTEWVKGKTVDQAMTISNKDVARELSLPPVKIHCSVLAEDAIKAAIEDFKKKRAARQAKAS

SEQ ID NO: 16467 - DNA, 384 bp, Haemophilus somnus 129PT
  CDS (1)..(384): transl_table=11
atggcatatagcgaaaaattacttgatcattatgaaaatcctcgtaatgtaggttcgtttgataaaaaagatccgacagtcggtagcggtatggttggtgcacctgcttgcggtgatgtcatgcaattacaaattaaagtaaatgatgaaggtatcattgaagatgctaaatttaaaacgtatggttgtggttcggcaattgcgtcaagttccttaatcactgaatgggtgaaaggtaaatctttagatgaagcccaagcgattaagaatagccaaattgctgaagagttggaattgccgccggttaaagtgcattgctcaattcttgcagaagatgcgattaaagctgcaattgctgattataaagcgaaaaaagctgaatag

SEQ ID NO: 16468 - protein, 127 aa, Haemophilus somnus 129PT
MAYSEKLLDHYENPRNVGSFDKKDPTVGSGMVGAPACGDVMQLQIKVNDEGIIEDAKFKTYGCGSAIASSSLITEWVKGKSLDEAQAIKNSQIAEELELPPVKVHCSILAEDAIKAAIADYKAKKAE

SEQ ID NO: 16469 - DNA, 384 bp, Shewanella sp. MR-4
  CDS (1)..(384): transl_table=11
atggcttacagtgaaaaagtgatagatcattatgagaacccacgtaacgttggttctttcgacaagaacgatccttcggtcgtgaccggtatggtgggagcacctgcctgtggtgacgtgatgaagttacagctgaaaatcggcgcagacggcatcatcgaagacgcaaagttcaaaacctacggttgtggcagcgcgattgcgtctagctcactggtaaccgagtgggtgaaaggcaagactatcgagcaagcggcggccatcaaaaacaccgatatcgcggaagaattagccttgccaccggtgaaaatccactgttctattttggcagaagatgccattaaagcggcgatcgacgagtacaaatcgaaacaagctaagtaa

SEQ ID NO: 16470 - protein, 127 aa, Shewanella sp. MR-4
MAYSEKVIDHYENPRNVGSFDKNDPSVVTGMVGAPACGDVMKLQLKIGADGIIEDAKFKTYGCGSAIASSSLVTEWVKGKTIEQAAAIKNTDIAEELALPPVKIHCSILAEDAIKAAIDEYKSKQAK

SEQ ID NO: 16471 - DNA, 393 bp, Magnetococcus sp. MC-1
  CDS (1)..(393): transl_table=11
atggcatacaatgagaaagtgctggaccactacgaaaagccccgcaacgtaggcagcatggataaagatgcagatgatgtgggaaccggcatggtgggggcgccctcatgcggtgatgtcatgaagctacagatcaaggttgacgacaatggcgtgattgaagatgccaagtttaagacctttggctgcggcagtgccattgcttcctcctcactggtgacggagtggattaaaggtaagaccattgatgaggcactgaccatcaaaaataaagatgtggccgaagagctggcgctgccaccggtaaaggttcactgttcggtgttggccgaggatgccattaaggcggcggttaaagattatcgtgaaaagcagcagaagaagggagcctga

SEQ ID NO: 16472 - protein, 130 aa, Magnetococcus sp. MC-1
MAYNEKVLDHYEKPRNVGSMDKDADDVGTGMVGAPSCGDVMKLQIKVDDNGVIEDAKFKTFGCGSAIASSSLVTEWIKGKTIDEALTIKNKDVAEELALPPVKVHCSVLAEDAIKAAVKDYREKQQKKGA

SEQ ID NO: 16473 - DNA, 384 bp, Azoarcus sp. BH72
  CDS (1)..(384): transl_table=11
atggcatacagcgacaaacttctggaccactacgaaaacccccgcaacgtcggctccttcggcaaggacgacgaaggcgtcgccaccggcatggttggcgcgcccgcgtgcggcgacgtgatgaagctgcagatcaaggtcggcaaggacggcgtgatcgaagacgcgaagttcaagacctacggctgcggctcggccatcgcctcgtcctcgctggtcaccgaatgggtgaagggcaagacgctggaccaggcgctggagatcaagaacacccagatcgccgaagaactggctttgccgccggtgaagatccattgttccatcctggccgaagacgcgatcaaggccgcggtggcggactacaagaagaagcacgaagcctga

SEQ ID NO: 16474 - protein, 127 aa, Azoarcus sp. BH72
MAYSDKLLDHYENPRNVGSFGKDDEGVATGMVGAPACGDVMKLQIKVGKDGVIEDAKFKTYGCGSAIASSSLVTEWVKGKTLDQALEIKNTQIAEELALPPVKIHCSILAEDAIKAAVADYKKKHEA

SEQ ID NO: 16475 - DNA, 381 bp, Magnetospirillum magnetotacticum MS-1
  CDS (1)..(381): transl_table=11
atggcttacagcgacaaggttatcgaccactacgagcatccccgcaatgtgggcgctctggacaaggacgattccgcggtcggcaccggtctggtgggcgcgcctgcctgcggcgacgtgatgaagctgcagatcaaggtcagcgccgagggcatcatcgaggacgccaagttcaagacgtttggttgcggctcggccatcgcctccagctctttggtgaccgaatgggtcaagggcaagaccctggacgaggcggccagcatcaagaacaccgatatcgctcaggaactggctttgccgccggtcaagatccattgttcggttctggccgaggatgctatcaaggccgccatcgccgactataagaagaagtccggctga

SEQ ID NO: 16476 - protein, 126 aa, Magnetospirillum magnetotacticum MS-1
MAYSDKVIDHYEHPRNVGALDKDDSAVGTGLVGAPACGDVMKLQIKVSAEGIIEDAKFKTFGCGSAIASSSLVTEWVKGKTLDEAASIKNTDIAQELALPPVKIHCSVLAEDAIKAAIADYKKKSG

SEQ ID NO: 16477 - DNA, 396 bp, Rickettsia sibirica 246
  CDS (1)..(396): transl_table=11
atggcttatagcaaaaaagtgatagatcattatgaaaatcctcgtaatgttggatcgcttgataaagaaaataaaaatgttggtacaggactagttggagctcctgcttgcggtgacgttatgaagttacaaatcgcagttgatgatgacgggattattacagatgctaaatttaaaacattcggctgcggttcagctattgcttcaagttctttagtaacggagtgggttaaaggaagatcggtagacgatgccgagactattaaaaataccgaaatagcaaaagaattgtcacttccaccggtcaaattacattgctcactacttgctgaagatgcaataaaagcagctatagccgattacaaacagaaaaaagaaagcaaaaaagactcttaa

SEQ ID NO: 16478 - protein, 131 aa, Rickettsia sibirica 246
MAYSKKVIDHYENPRNVGSLDKENKNVGTGLVGAPACGDVMKLQIAVDDDGIITDAKFKTFGCGSAIASSSLVTEWVKGRSVDDAETIKNTEIAKELSLPPVKLHCSLLAEDAIKAAIADYKQKKESKKDS

SEQ ID NO: 16479 - DNA, 384 bp, Pseudoalteromonas tunicata D2
  CDS (1)..(384): transl_table=11
atggcttacagcgataaagtattagatcatgttgcaaatccacgtaatgtgggtgcgtttgataaaaacgatccatcggtagcaactggaatggtaggggctcctgcctgtggcgacgtaatgaagctacaaatcaaagtatctccagaaggtattattgaagatgctaaatttaaaacttatggttgtggtagtgcaattgcttcctcatcattagtaactgagtgggttaagggtaaaacactagatcaagctgctgaaatcaaaaatacagatatcagcgctgaattagagcttccaccagtaaaaattcactgctcaattttagcagaagacgcaattcaagcagcaattgcagactataagagcaagcacggtaaataa

SEQ ID NO: 16480 - protein, 127 aa, Pseudoalteromonas tunicata D2
MAYSDKVLDHVANPRNVGAFDKNDPSVATGMVGAPACGDVMKLQIKVSPEGIIEDAKFKTYGCGSAIASSSLVTEWVKGKTLDQAAEIKNTDISAELELPPVKIHCSILAEDAIQAAIADYKSKHGK

SEQ ID NO: 16481 - DNA, 387 bp, Photobacterium sp. SKA34
  CDS (1)..(387): transl_table=11
atggcatatagtgaaaaagtcatcgatcattatgaaaatccgcgtaacgtgggttcatttgacaaagatgatcaaaatgtaggtagtggcatggtgggagcaccagcatgtggcgatgtaatgaaacttcagattaaagtaactgaagaaggcattattgaagatgcaaaattcaaaacctatggttgtggctctgcaattgcttctagctcactgattactgagtgggttaaaggtaaaacattagatgaagctgcatcaatcaagaactctgcgattgctgaagagcttgagttaccaccggttaaagttcactgttcaattcttgcagaagatgcaattaaagcagcagttagcgattataaaaagaaacacgagcaaaaataa

SEQ ID NO: 16482 - protein, 128 aa, Photobacterium sp. SKA34
MAYSEKVIDHYENPRNVGSFDKDDQNVGSGMVGAPACGDVMKLQIKVTEEGIIEDAKFKTYGCGSAIASSSLITEWVKGKTLDEAASIKNSAIAEELELPPVKVHCSILAEDAIKAAVSDYKKKHEQK

SEQ ID NO: 16483 - DNA, 384 bp, Oceanospirillum sp. MED92
  CDS (1)..(384): transl_table=11
atggcttatagtgacaaagttattgatcattacgagaatcctcgtaatgttggcaaaatgaatgataaagacagcaacgttggtacaggtatggttggagcgcctgcttgtggtgacgttatgcgtctgcagattaaagtaagtgatgagggcatcattgaagatgctaagttcaaaacttacggttgtggttcagcgatcgcttccagctcactcgtgactgagtgggttaagggtatgagcctggatgaagctgctgagcttaaaaatacgtctattgccgaagagttggctctgcctccagtgaaaattcactgttcagtactggctgaagacgctattaaagccgctgttgcggactacaaagagaagcaagataagtaa

SEQ ID NO: 16484 - protein, 127 aa, Oceanospirillum sp. MED92
MAYSDKVIDHYENPRNVGKMNDKDSNVGTGMVGAPACGDVMRLQIKVSDEGIIEDAKFKTYGCGSAIASSSLVTEWVKGMSLDEAAELKNTSIAEELALPPVKIHCSVLAEDAIKAAVADYKEKQDK

SEQ ID NO: 16485 - DNA, 384 bp, Alteromonadales bacterium TW-7
  CDS (1)..(384)
atggcgtacagtgataaagtaatcgaccacgtagaaaacccacgtaacgtaggtgctctagacaaaaacgatccgtcagtggcaacgggtatggtaggcgcaccagcatgtggtgacgtaatgaaattgcaaattaaagtatcggatactggcgttattgaagatgcaaaattcaaaacctacggttgtggtagcgcaattgcctcttcttcacttgtaacagagtgggttaagggtaaaacacttgatgaagcagcaaccatcaaaaacactgatatcagtgctgagctagaattaccaccagtgaaaattcactgttcaattttagccgaagatgcaattcaagcagcaattgcagactacaaaagcaaacaagcgaagtaa

SEQ ID NO: 16486 - protein, 127 aa, Alteromonadales bacterium TW-7
MAYSDKVIDHVENPRNVGALDKNDPSVATGMVGAPACGDVMKLQIKVSDTGVIEDAKFKTYGCGSAIASSSLVTEWVKGKTLDEAATIKNTDISAELELPPVKIHCSILAEDAIQAAIADYKSKQAK

SEQ ID NO: 16487 - DNA, 384 bp, marine gamma proteobacterium HTCC2080
  CDS (1)..(384): transl_table=11
atggcttacagtgaaaaggttatcgatcattatgagaaccccaggaatgtgggaaagttcgatgatgaagatgaaaacataggtacgggtatggtaggtgcgccggcctgtggcgatgtcatgcgtctacagatcaaggtaaatgataatggcgttattgaggacgccaaatttaaaacctacggctgtggctcagcgatagcatcaagttctctgctgacggaatgggtcaaagggcgcaagcttgaagacgccgagcaaattacaaatactgaaatagcacaggaattgtcactgccaccggtgaaaattcattgttcggtgctcgcagaggatgccattaaggcggcggtaaagaattttcgagaaaagcaggacgactga

SEQ ID NO: 16488 - protein, 127 aa, marine gamma proteobacterium HTCC2080
MAYSEKVIDHYENPRNVGKFDDEDENIGTGMVGAPACGDVMRLQIKVNDNGVIEDAKFKTYGCGSAIASSSLLTEWVKGRKLEDAEQITNTEIAQELSLPPVKIHCSVLAEDAIKAAVKNFREKQDD

SEQ ID NO: 16489 - DNA, 516 bp, Oryza sativa subsp
  CDS (1)..(516)
atgctgcgcgcgggagggaggcggctcttggcccccgggctccggcgggtcctcggcggcggggcggccgctccggtggccgtgggcggggcgagggcgtaccacgagcgggtggtggaccactacgagaacccgcggaacgtggggtcgttcgagaacgacgaccccagcgtcgggacggggctggtgggggcgccggcctgcggcgacgtgatgaagctgcagatccgcgtcgacgagagctccggcaagatcgtcgacgcatgcttcaagacctttgggtgcggatccgccatcgcgtcctcctccgtcgctactgaatgggtaaagggcaagcaaatggaggaagtagtgactataaaaaacactgagattgccaagcacttgtcacttccaccagtaaagctccattgtagcatgcttgctgaggatgcaattaaagctgccgtgaaagactatgaagcaaagaaggcaaagctagcacaaaagggtgaagagaaggctgccgaagcatga

SEQ ID NO: 16490 - protein, 171 aa, Oryza sativa subsp
MLRAGGRRLLAPGLRRVLGGGAAAPVAVGGARAYHERVVDHYENPRNVGSFENDDPSVGTGLVGAPACGDVMKLQIRVDESSGKIVDACFKTFGCGSAIASSSVATEWVKGKQMEEVVTIKNTEIAKHLSLPPVKLHCSMLAEDAIKAAVKDYEAKKAKLAQKGEEKAAEA

SEQ ID NO: 16491 - DNA, 468 bp, Vitis vinifera
  CDS (1)..(468)
atgcttaggagcggctgcagcaggattctagggttagggcaacagggcaagcaggctcaatcgcaggcccttcttcgtttctatcatgagagggtggtggaccattacaataacccccgcaacgtgggatccttcgacaagaacgatccagacgtcggcactggcctcgttggcgctccagcttgcggtgatgtcatgaagcttcaaatcaaggtcgatgatcaaaccggaaagatcgtcgatgcttgcttcaagacctttggttgtggatccgccatcgcctcttcctctgttgccacggaatgggtgaaaggcaagcaaacggaggaagttctatccataaaaaatacggagattgccaaacatctctctcttcctccagtgaagctgcactgcagcatgcttgctgaggatgcaattaaggcagctgtcaaagattatgaagccaagcgagcaaagactgagtag

SEQ ID NO: 16492 - protein, 155 aa, Vitis vinifera
MLRSGCSRILGLGQQGKQAQSQALLRFYHERVVDHYNNPRNVGSFDKNDPDVGTGLVGAPACGDVMKLQIKVDDQTGKIVDACFKTFGCGSAIASSSVATEWVKGKQTEEVLSIKNTEIAKHLSLPPVKLHCSMLAEDAIKAAVKDYEAKRAKTE

SEQ ID NO: 16493 - DNA, 486 bp, Argas monolakensis
  CDS (1)..(486)
atggcccttttccgcacgattcacaggtctctttcaccagtcaagcggacagtcgccgcgacaggcgcggtaggctatcacgaaaaggtcatcgatcattacgagaaccctcgaaacgtcggttctctgaacaaggatgccactaacgtcggcacgggtctggtcggagctccagcctgcggcgatgtcatgaagttacagattatggtggacgagaatgggaagatagtggatgccaaattcaagacgttcggctgcggttccgcgattgcctccagctctcttgccacggaatggatcaagggaaaaaacgtgaatgacgccatgaagatcaagaacacggagattgccaaagagctcagcctgcctccggtgaagcttcactgctccatgttggccgaggacgcgatcaaggccgctctcaacgactacaagcgcaaacagacgcaggggaaagatgcggacgcttcggcgagcaaggggtag

SEQ ID NO: 16494 - protein, 161 aa, Argas monolakensis
MALFRTIHRSLSPVKRTVAATGAVGYHEKVIDHYENPRNVGSLNKDATNVGTGLVGAPACGDVMKLQIMVDENGKIVDAKFKTFGCGSAIASSSLATEWIKGKNVNDAMKIKNTEIAKELSLPPVKLHCSMLAEDAIKAALNDYKRKQTQGKDADASASKG

SEQ ID NO: 16495 - DNA, 447 bp, Candidatus Kuenenia stuttgartiensis
  CDS (1)..(447): transl_table=11
atgcaatatagcgcaaaggtaatggatcattttgcaaatccgcgtaatgtaggagaagttgctgaggcagatggcgttggcgaggtgggaaaccctgcatgcggcgatatcatgaagatgtccattaaggtgaaggataatgtaatagttgacgcaaagtttaaaacattcggctgcggggcggctattgcaaccagcagtatttctacagaaatgattataggaaaaacgcttgacgaagcgttgcggcttaccaataaagcagtcgcagaagcattggatggcttgccgccggcaaaaatgcattgttctgtattggcagaagaagcaattgaagccgctatcgatgactaccttaagaaaacaacgggaaaaggcctggagaaaaagaaggggcattcacacgaagagcatcaccaccatgaacccgatttccggccaaattaa

SEQ ID NO: 16496 - protein, 148 aa, Candidatus Kuenenia stuttgartiensis
MQYSAKVMDHFANPRNVGEVAEADGVGEVGNPACGDIMKMSIKVKDNVIVDAKFKTFGCGAAIATSSISTEMIIGKTLDEALRLTNKAVAEALDGLPPAKMHCSVLAEEAIEAAIDDYLKKTTGKGLEKKKGHSHEEHHHHEPDFRPN

SEQ ID NO: 16497 - DNA, 573 bp, Aspergillus oryzae
  CDS (1)..(573)
atgcttagtcataaaagtactgccccccgaataggactagccgcaattaaacgatctacctactttttcttttttacctctcccacagtcgccaacatcttcctcaatcaaccacgtatgaacctcgaaaactttaatagtcccaaagttggcagtttcaacaagaacgatgccgatgttgccactggtcttgttggcgcccccgcttgcggtgatgtcatgaagcttcagattcgtgttgacaaggatacgaatgtgatcagcgatgtcaggttcaagacatttggctgtggcagcgccatcgctagttcgagttacctgacagagttggtgcgcggtatgactctcgaggaggccggaaaaattaagaatactgaaattgcccgtgaacttttgccgcccgtgaagttgcactgctcgatgcttgctgaggacgccatcaagtccgcgatttccaactactacaccaagaaccctaacgctcgtacaaccaaccttggaggtaccggtgcctctatccctaacgtcaaggtcgagattgagaagtccgagggtgccgctgctactgcttaa

SEQ ID NO: 16498 - protein, 190 aa, Aspergillus oryzae
MLSHKSTAPRIGLAAIKRSTYFFFFTSPTVANIFLNQPRMNLENFNSPKVGSFNKNDADVATGLVGAPACGDVMKLQIRVDKDTNVISDVRFKTFGCGSAIASSSYLTELVRGMTLEEAGKIKNTEIARELLPPVKLHCSMLAEDAIKSAISNYYTKNPNARTTNLGGTGASIPNVKVEIEKSEGAAATA

SEQ ID NO: 16499 - DNA, 489 bp, Arabidopsis thaliana
  CDS (1)..(489)
atgatgctaaggcaaacgtcgagaaaggcttacctagggttacaggcgtctcctctagggttaggtcgtcgattataccacgagaatgtaatcgaccactttgaaaaccctagaaacgttggctccttcaacaggaatgaccctaacgttggcacgggattggtaggagctcctgcctgcggagacctcatgagcctccagattaaggtcgatgattcaggtcagatcattgatactcgattcaagacctttggctgtggctccgctatcgcctcatcttccgttgcttctgaatggatcaagggcaaaaccttagacgaagttatgaccatcaagaacgcggaaatcgctaagcatcttaggttgccaccggtaaagctacattgcagtatgcttgcagaggacgctatcaagtccgcggtcagagactacaaggagaagcaagcaaagactaatgctgctgctgcagaagaaaccgtcaaggcctga

SEQ ID NO: 16500 - protein, 162 aa, Arabidopsis thaliana
MMLRQTSRKAYLGLQASPLGLGRRLYHENVIDHFENPRNVGSFNRNDPNVGTGLVGAPACGDLMSLQIKVDDSGQIIDTRFKTFGCGSAIASSSVASEWIKGKTLDEVMTIKNAEIAKHLRLPPVKLHCSMLAEDAIKSAVRDYKEKQAKTNAAAAEETVKA

SEQ ID NO: 16501 - DNA, 381 bp, uncultured marine bacterium 580
  CDS (1)..(381)
atggcgtatagcgataaagttttagatcattatgaaaacccaagaaatgttggatcatttaataaagaagattcaaatgtgggtacgggtatggttggcgcacctgcgtgtggcgatgtaatgaagttacaaatcaagatgggaaatgatggaattattgaagatgcaaaatttaagacctacggttgtggttctgcaattgcttcgagctcattagttacagaatggctgaaaggtaaatcattagatcaagcatcagagattaaaaattctgccatcgcagaagaattagctttacctccagttaaaattcattgttctgttttagctgaagatgccattaaagctgccgttgaagatttaaaatctaaacaaaaataa

SEQ ID NO: 16502 - protein, 126 aa, uncultured marine bacterium 580
MAYSDKVLDHYENPRNVGSFNKEDSNVGTGMVGAPACGDVMKLQIKMGNDGIIEDAKFKTYGCGSAIASSSLVTEWLKGKSLDQASEIKNSAIAEELALPPVKIHCSVLAEDAIKAAVEDLKSKQK

SEQ ID NO: 16503 - DNA, 495 bp, Branchiostoma belcheri tsingtauense
  CDS (1)..(495)
atgtctcttttgagacatctggggaagtctctgcgccccatggtgggtgcgagggccacagcagtgccgacggcgggttatcacgagaatgtgatcgaccattatgagaaccccaggaacgtgggatcgatggacaagaacgacaagaaagtggggacaggactggtgggggcacctgcctgtggggacgtcatgaagttacagattctggtagatgatgatgggaagattgttgatgccaagttcaagacgtttggctgtgggtcagccatcgcttccagctcactggctacagaatgggtcaagggcaagtcaatggatgaggctgctaccatcaagaacactgatattgccaaggagctgtgtcttccacctgtcaagctgcactgctcaatgctcgccgaagacgccatcagagcagcggtgaacgactacaaactgaagaacaaaccagctgaagagtcacatgacgaaaaggctgcagcgcaggcctag

SEQ ID NO: 16504 - protein, 164 aa, Branchiostoma belcheri tsingtauense
MSLLRHLGKSLRPMVGARATAVPTAGYHENVIDHYENPRNVGSMDKNDKKVGTGLVGAPACGDVMKLQILVDDDGKIVDAKFKTFGCGSAIASSSLATEWVKGKSMDEAATIKNTDIAKELCLPPVKLHCSMLAEDAIRAAVNDYKLKNKPAEESHDEKAAAQA

SEQ ID NO: 16505 - DNA, 384 bp, Leptospirillum ferrooxidans
  CDS (1)..(384): transl_table=11
atggcatacagcgacaaggtcatcgaccactacaacaaccccagaaacatgggttcatttgacaaatcggacgaaaacgtcggaacgggtattgtcggcgcacccgagtgcggcgatgtcatgaagcttcagctgaagatcaatgacgatggtatcattgaggaggccaagttcaagacctttggctgtggcagtgccattgcatcaagctcgcttgcaacagaatgggtcaaggggaagacgatcgatgaagcactcaagatcaaaaacaccgacatcgtccaggagttgaacctgccccccgtcaagattcattgttccgttttggcagaagatgcgatcaagggagctattcaggactaccaggagaaaaaaaaccgttga

SEQ ID NO: 16506 - protein, 127 aa, Leptospirillum ferrooxidans
MAYSDKVIDHYNNPRNMGSFDKSDENVGTGIVGAPECGDVMKLQLKINDDGIIEEAKFKTFGCGSAIASSSLATEWVKGKTIDEALKIKNTDIVQELNLPPVKIHCSVLAEDAIKGAIQDYQEKKNR

SEQ ID NO: 16507 - DNA, 501 bp, Arabidopsis thaliana
  CDS (1)..(501)
atgctcaagcaagctgcgaagaaggctctagggcttacgtcacgtcaatcaacaccgtggtctgttagtatcttccgaacctaccatgagaacgtcatcgaccactacgataatccccgcaacgttgggtctttcgataagaatgatcccaacgttggcacgggactcgtaggagctcccgcttgtggtgatgtgatgaagcttcaaatcaaggtcgatgagaagactggtcaaatcgttgatgctcgctttaagacttttggttgtggttcagctatcgcttcttcatctgttgccactgaatgggtgaaaggcaaagctatggaggatgttctgaccatcaaaaacaccgaaatcgcaaagcatctttctctcccaccagtcaagctccactgcagtatgttggcggaggacgctatcaaggcagctgtgaaagactacaaggagaagcgtgtgaagacaaatggtgctgcagcagcaggagaaaccacacaggcttga

SEQ ID NO: 16508 - protein, 166 aa, Arabidopsis thaliana
MLKQAAKKALGLTSRQSTPWSVSIFRTYHENVIDHYDNPRNVGSFDKNDPNVGTGLVGAPACGDVMKLQIKVDEKTGQIVDARFKTFGCGSAIASSSVATEWVKGKAMEDVLTIKNTEIAKHLSLPPVKLHCSMLAEDAIKAAVKDYKEKRVKTNGAAAAGETTQA

SEQ ID NO: 16509 - DNA, 465 bp, Ashbya gossypii
  CDS (1)..(465)
atgctaggattcagacagacagccactgcaatcgtgaggccggtcggcaccatagggtatgcgcggcgctgctaccaccccaaggtcatagaccactacaccaaccctcgcaacgttggcacattggacaagaagcttacaaatgtcgggaccgggctcgtgggcgcgccggcgtgtggcgacgtgatgcgcctgcagatccaggtggacgacagcacaggcgtaatcgagaacgtgaagttcaagacgtttggctgcggctcggccattgcgtcatcttcgtacatgaccgagcttgtgcgcggcaagacgctcgcggatgcggagaagatcaagaacacagagatcgcgcgcgagctatcgcttccgccggtcaagctgcactgtagtatgctcgcggaggacgccatcaaggccgccatcaaggactaccgcagcaagcgcaaggcgaccgagctgcgctga

SEQ ID NO: 16510 - protein, 154 aa, Ashbya gossypii
MLGFRQTATAIVRPVGTIGYARRCYHPKVIDHYTNPRNVGTLDKKLTNVGTGLVGAPACGDVMRLQIQVDDSTGVIENVKFKTFGCGSAIASSSYMTELVRGKTLADAEKIKNTEIARELSLPPVKLHCSMLAEDAIKAAIKDYRSKRKATELR

SEQ ID NO: 16511 - DNA, 642 bp, Candida glabrata
  CDS (1)..(642)
atgggggtgtgtgtcttcttcccactgtgtcttccatgcccaggggctctcacatatataagagaagcacaattcatttcatcttggaccccggcagaccccagacacaagcaactaaaaatgtttttgcagagatttgtgacagtaggcggtgctgccattggagctagaagtactatgggtgccatgggtgccataggtgccataggtgccaagggcactatgaacaatatcggaaggaggatgtatcatcccaaggttatagagcattacacgcaccctaggaatgtggggtctatggacaagacgcttcctaatgtgggtactggtctggttggtgcgcctgcgtgtggcgatgtgatgagactgcagatcaaggttaatgacaagacgggcgtgatagaggacgtgaagttcaagacgttcgggtgcggttccgcgatcgcttcctcctcgtatatgactgagctagtgcacggcatgaccttggatgacgccgccaagatcaagaacacaaccatcgcaaaggagttgagtctgccacctgtcaaactgcactgctctatgctagcagaggacgctatcaaggcagcaattaaggactacaagtctaagagaacatctacgacaacactgcactag

SEQ ID NO: 16512 - protein, 213 aa, Candida glabrata
MGVCVFFPLCLPCPGALTYIREAQFISSWTPADPRHKQLKMFLQRFVTVGGAAIGARSTMGAMGAIGAIGAKGTMNNIGRRMYHPKVIEHYTHPRNVGSMDKTLPNVGTGLVGAPACGDVMRLQIKVNDKTGVIEDVKFKTFGCGSAIASSSYMTELVHGMTLDDAAKIKNTTIAKELSLPPVKLHCSMLAEDAIKAAIKDYKSKRTSTTTLH

SEQ ID NO: 16513 - DNA, 540 bp, Debaryomyces hansenii
  CDS (1)..(540)
atgataagtagatcatttttgagattagctaacccagctagaagggctatgccagcagttaaaagagtcaacatgatgccatccatggcacttcctaccaagagattatatcacgaaaaggttcttgatcactactcaaaccctagaaatgtcggtacattaaataaactcgatgtggatgtcggtaccggattagtgggagccccagcatgtggtgatgttatgagattacagatacaggtagacgatgagaccggagttatcaaggatgtgaagtttaagacttttggttgtggatcagccattgcttcgtcttcgtaccttacggaattggtcaagggtaaaactattgaagaggccgtaaagattaagaacacagctattgcaaaggaattgtcattacctccggtgaagttgcactgttctatgttggccgaagacgcaattaagagtgcagttaaggactacagatcaaagagaagcgtcaagcaaccaaccttaggtccagaagctgcacaggctgaaaccatcgccacataa

SEQ ID NO: 16514 - protein, 179 aa, Debaryomyces hansenii
MISRSFLRLANPARRAMPAVKRVNMMPSMALPTKRLYHEKVLDHYSNPRNVGTLNKLDVDVGTGLVGAPACGDVMRLQIQVDDETGVIKDVKFKTFGCGSAIASSSYLTELVKGKTIEEAVKIKNTAIAKELSLPPVKLHCSMLAEDAIKSAVKDYRSKRSVKQPTLGPEAAQAETIAT

SEQ ID NO: 16515 - DNA, 543 bp, Kluyveromyces lactis
  CDS (1)..(543)
atgtttagaggacaaatgtttgcagtacagaggatgggaagtgcactaatgcacggcggtggaggcggaactagaataatcggtgtagcagctgctagagcaactgctcctaccgtcggctctagtccttccatggcctctgctagattttaccatccaaaggtcattgatcattatacaaacccaagaaatgttgggtctctagacaagaatttgccaaatgttggaacgggtcttgtcggtgccccagcttgtggtgatgtgatgaaattgcaaatccaagttaacgacgaaacaggagtgatagaaaacgttaagttcaagacgttcgggtgcgggtctgccatcgcttcttcttcatacatgaccgaattggtccgtgggaaaaccttggaagatgcagcaaagattaaaaatacagaaatcgccagagaattgagtttacctccggttaaattgcattgttctatgttggctgaagatgccatcaaggctgccatcaaggattaccaggctaagagacctacaacacagttgaaatag

SEQ ID NO: 16516 - protein, 180 aa, Kluyveromyces lactis
MFRGQMFAVQRMGSALMHGGGGGTRIIGVAAARATAPTVGSSPSMASARFYHPKVIDHYTNPRNVGSLDKNLPNVGTGLVGAPACGDVMKLQIQVNDETGVIENVKFKTFGCGSAIASSSYMTELVRGKTLEDAAKIKNTEIARELSLPPVKLHCSMLAEDAIKAAIKDYQAKRPTTQLK

SEQ ID NO: 16517 - DNA, 579 bp, Schizosaccharomyces pombe
  CDS (1)..(579)
atgagtgtcttccgtcgctccgttcaatgcgttggcgttttgccttcaattttggctcaacgctcttctcttcttgcccgtccagcgaatttacagtttctcaaaacgaactcgtcaaaattcgtccctcaagtcaccgcaaacgtctctcgtcgtatgtaccataagaatgttttagaccattacaacaatcctcggaatgtgggtactttgcccaaaggtgatcccgatgtgggtatcggcttggtaggtgctcccgcctgtggcgatgttatgcgccttgctattcgtgtcaataaggatggtgttattgaggacgtaaagttcaagacctttggttgtggtagtgcaattgcctcgtcatcctacgttaccactatggtcaagggcatgacccttgaggaggcttctaaaattaaaaacacccaaattgccaaagagctttgcttgcctcctgtaaaacttcattgctccatgcttgccgaggatgccattaaaagcgctgtaaagcattatcgctctaaacaattaacgcctgttggtacaactgctggcgctattgagtctgctaccgcttag

SEQ ID NO: 16518 - protein, 192 aa, Schizosaccharomyces pombe
MSVFRRSVQCVGVLPSILAQRSSLLARPANLQFLKTNSSKFVPQVTANVSRRMYHKNVLDHYNNPRNVGTLPKGDPDVGIGLVGAPACGDVMRLAIRVNKDGVIEDVKFKTFGCGSAIASSSYVTTMVKGMTLEEASKIKNTQIAKELCLPPVKLHCSMLAEDAIKSAVKHYRSKQLTPVGTTAGAIESATA

SEQ ID NO: 16519 - DNA, 546 bp, Yarrowia lipolytica
  CDS (1)..(546)
atgatgttcaacagaattacccgatctgccggtctgctcgctcgagcccgacccaccaccaccgccgtcatgtctcccatgacccctcttgccatctctcgacgaggctaccacgagaaggtgctggaccactacaacaacccccgaaacgtgggatccatgaacaagaatgacgaggacgtcggaactggtctggttggagcccccgcctgtggcgatgtcatgaagctgcagattcgagtggacgacaacggagtcatccaggacgtcaagttcaagacctttggctgtggcagtgccattgcctcctcttcctacgtgactgagcttgttcgaggcaagtctctggctgaggctggcaagatcaagaacaccgtcattgccaaggagctgtctcttccccccgtcaaactgcattgctccatgctggctgaggacgccatcaagtctgccatcagcgattacaacagcaagcgaaagaccaagaaccccactcttggtgccgaggctgcagagactcctgctgccgccactgccactgcctaa

SEQ ID NO: 16520 - protein, 181 aa, Yarrowia lipolytica
MMFNRITRSAGLLARARPTTTAVMSPMTPLAISRRGYHEKVLDHYNNPRNVGSMNKNDEDVGTGLVGAPACGDVMKLQIRVDDNGVIQDVKFKTFGCGSAIASSSYVTELVRGKSLAEAGKIKNTVIAKELSLPPVKLHCSMLAEDAIKSAISDYNSKRKTKNPTLGAEAAETPAAATATA

SEQ ID NO: 16521 - DNA, 498 bp, Saccharomyces cerevisiae
  CDS (1)..(498)
atgcttcctgttataacgagatttgcaaggcctgctctgatggccatcagacctgtgaatgccatgggggttttgagagcgtccagcataacgaaaaggctttatcatcccaaggtcatagagcattatacacatccaagaaacgtcggctcattagataaaaaattgcccaacgtcggcactggtctagtgggtgcgccagcgtgcggtgatgtgatgaggttgcagatcaaagtcaacgactctactggcgttattgaagatgtcaaattcaaaacttttggatgtggctccgccattgcctcctcttcatatatgactgaattggtacaggggatgaccttggacgatgcggcaaaaattaagaacactgaaattgctaaggagttgagcttgcccccagtcaagttgcattgctctatgttagcggaagatgcgatcaaggcagctattaaggactacaaatctaagagaaacactccaaccatgttatcgtaa

SEQ ID NO: 16522 - protein, 165 aa, Saccharomyces cerevisiae [sequence omitted]

SEQ ID NO: 16523 - DNA, 384 bp, Buchnera aphidicola subsp
  CDS (1)..(384): transl_table=11
atggcttatagtaaaaaagtaatggatcattatgaaaatccacgtaatgtgggatctttttctagtactgatcttaatgtaggtagtgggttagtaggtgcgcctgcttgtggtgatgtaatgaaattacaaataaaagttaatgaaaaaggtattattgaagatgcttgttttaaaacatatggttgtggttctgctatagcatcaagttcattagttactgaatgggtaaagggcaaatctatagaagaagccgaatcaatcaaaaatactactatagttgaagaattagatctacctccagtaaaaattcactgttctattttagcagaagatgcaattaaagcagctatttctgattataagagaaaaaaaataaattaa

SEQ ID NO: 16524 - protein, 127 aa, Buchnera aphidicola subsp
MAYSKKVMDHYENPRNVGSFSSTDLNVGSGLVGAPACGDVMKLQIKVNEKGIIEDACFKTYGCGSAIASSSLVTEWVKGKSIEEAESIKNTTIVEELDLPPVKIHCSILAEDAIKAAISDYKRKKIN

SEQ ID NO: 16525 - DNA, 387 bp, Buchnera aphidicola subsp
  CDS (1)..(387): transl_table=11
atggcttatagcaaaaaagttatggatcattatgaaaatccacgtaatgttggttccttttctaattctgattctaatgtaggaagtggattggtaggtgcacctgcttgtggtgatgtgatgaaattacaaattaaagttaatgaacaaggtattattgaagatgcttgctttaaaacgtatggttgtggttctgcaatagcctctagttctttggttacagaatggattaagggtaaatctataacggaagcagaagcaattaaaaatactagtatagttgaagaactagaattgccaccagtaaaaatacattgttctattttagcagaggatgctattaaagctgctatttcagattataaaagtaagaaaaataaaaattaa

SEQ ID NO: 16526 - protein, 128 aa, Buchnera aphidicola subsp
MAYSKKVMDHYENPRNVGSFSNSDSNVGSGLVGAPACGDVMKLQIKVNEQGIIEDACFKTYGCGSAIASSSLVTEWIKGKSITEAEAIKNTSIVEELELPPVKIHCSILAEDAIKAAISDYKSKKNKN

SEQ ID NO: 16527 - DNA, 381 bp, Buchnera aphidicola subsp
  CDS (1)..(381): transl_table=11
atggcatatagtaaaaaagtaatagatcattatgaaaacccccgaaatgtaggttcatttaagactattgatgcaaacgttggaagtggtttagtcggcgcaccagcatgtggggatgttatgaaattacaaatcaaagttaataaaaacgggattatccaagatgcatgttttaaaacctatggttgcgggtcagccattgcttccagttctttggtaaccgaatggatcaaaggaaaatcattaatagaagcagaaaatataaaaaatactaatattgcagaagaacttgatttacctccagtaaaaatacattgttctatcttggcagaagatgctattaaagctgctattactgactataaaaataaaaacaaataa

SEQ ID NO: 16528 - protein, 126 aa, Buchnera aphidicola subsp
MAYSKKVIDHYENPRNVGSFKTIDANVGSGLVGAPACGDVMKLQIKVNKNGIIQDACFKTYGCGSAIASSSLVTEWIKGKSLIEAENIKNTNIAEELDLPPVKIHCSILAEDAIKAAITDYKNKNK

SEQ ID NO: 16529 - DNA, 387 bp, Escherichia coli O157
  CDS (1)..(387): transl_table=11
atggcttacagcgaaaaagttatcgaccattacgagaatccgcgtaacgtgggttcctttgacaacaacgacgagaacgtcggcagcggcatggtgggtgcaccggcctgtggcgacgtaatgaagttgcagattaaagtcaacgatgaaggtatcattgaagacgcgcgttttaaaacttacggctgcggttctgctatcgcttccagctccctggtcaccgaatgggtgaaagggaagtctctcgacgaagcgcaggctatcaaaaacaccgatattgctgaagaacttgaactgccgccggtgaaaattcactgttctattctggcagaagacgcgatcaaagccgccattgcggactataaaagcaaacgtgaagcaaaataa

SEQ ID NO: 16530 - protein, 128 aa, Escherichia coli O157
MAYSEKVIDHYENPRNVGSFDNNDENVGSGMVGAPACGDVMKLQIKVNDEGIIEDARFKTYGCGSAIASSSLVTEWVKGKSLDEAQAIKNTDIAEELELPPVKIHCSILAEDAIKAAIADYKSKREAK

SEQ ID NO: 16531 - DNA, 381 bp, Haemophilus influenzae
  CDS (1)..(381): transl_table=11
atggcttatagcgaaaaagtaattgatcattatgaaaatccacgtaatgtgggatcattggataaaaaagatagcaatgttggtactggaatggttggtgcgccagcttgtggtgatgttatgcaactacaaatcaaagtagatgataatggcattattgaagatgcaaaattcaaaacttacggctgtggttctgcgattgcatctagttcattaattactgagtgggtaaaaggtaaatctttagaagaagctggagcaattaaaaatagccaaattgctgaagaattagaattaccgccagtgaaagtgcattgctctattttagcagaagatgcaattaaagcagcaattgctgattataaagcaaaacaaggctaa

SEQ ID NO: 16532 - protein, 126 aa, Haemophilus influenzae
MAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQG

SEQ ID NO: 16533 - DNA, 396 bp, Rickettsia prowazekii
  CDS (1)..(396): transl_table=11
atggcttatagcaaaaaagtgatagatcattatgaaaaccctcgtaatgttgggtcacttgataaaaagaaaaaaaatgttggtacaggactcgttggagctcctgcttgcggtgacgttatgaaattacaaatcgaagttggcgatgacgaaattattacagatgctaaatttaaaacattcggttgcggttcggctattgcttcaagttctctagtcacagagtggattaaaggaaaatcagtagaagatgcaaaagagattaaaaatactgaaatagcaaaagaattatcactgccgccggtaaaattacattgttcactcctggcagaagatgcaataaaagcagctattgctgattataaacagaaaagagaaaacaaaaaagattcttaa

SEQ ID NO: 16534 - protein, 131 aa, Rickettsia prowazekii
MAYSKKVIDHYENPRNVGSLDKKKKNVGTGLVGAPACGDVMKLQIEVGDDEIITDAKFKTFGCGSAIASSSLVTEWIKGKSVEDAKEIKNTEIAKELSLPPVKLHCSLLAEDAIKAAIADYKQKRENKKDS

SEQ ID NO: 16535 - DNA, 516 bp, Oryza sativa
  CDS (1)..(516)
atgctgcgcgcgggagggaggcggctcttggcccccgggctccggcgggtcctcggcggcggggcggccgctccggtggccgtgggcggggcgaaggcgtaccacgagcgggtggtggaccactacgagaacccgcggaacgtggggtcgttcgagaacgacgaccccagcgtcgggacggggctggtgggggcgccggcctgcggcgacgtgatgaagctgcagatccgcgtcgacgagagctccggcaagatcgtcgacgcatgcttcaagacctttgggtgcggatccgccatcgcgtcctcctccgtcgctactgaatgggtaaagggcaagcaaatggaggaagtagtgactataaaaaacactgagattgccaagcacttgtcacttccaccagtaaagctccattgtagcatgcttgctgaggatgcaattaaagctgccgtgaaagactatgaagcaaagaaggcgaagctagcacaaaagggtgaagagaaggctgccgaagcatga

SEQ ID NO: 16536 - protein, 171 aa, Oryza sativa
MLRAGGRRLLAPGLRRVLGGGAAAPVAVGGAKAYHERVVDHYENPRNVGSFENDDPSVGTGLVGAPACGDVMKLQIRVDESSGKIVDACFKTFGCGSAIASSSVATEWVKGKQMEEVVTIKNTEIAKHLSLPPVKLHCSMLAEDAIKAAVKDYEAKKAKLAQKGEEKAAEA

SEQ ID NO: 16537 - DNA, 495 bp, Brassica napus
  CDS (1)..(495)
atgatgctcaggcaagctgcgaagaaggctctaggcctcacgtcacgccaatcgaccccgtgttccgttggtatctcccgatcctaccacgagaacgtcatcgaccactacgacaacccccgcaacgtcgggtctttcgacaagaacgatcccagcatcggcacgggcctcgtcggagctcccgcgtgcggtgatgtgatgaagcttcagatcaaggtcgatgagaagaccggtcagatcgtcgatgctcggttcaagacctttggttgtggctccgctatcgcctcttcatctgtcgccactgaatgggtgaaaggcaaagctatggaggaagttctgaccatcaaaaacactgagattgcgaagcatctttctctcccaccagtgaagctccattgcagtatgttggcggaggacgccatcaaggcagctgtgaaagactacaaggagaagcgtgtgaaggcaaacggtgttggagaaagctcacaggcttga

SEQ ID NO: 16538 - protein, 164 aa, Brassica napus
MMLRQAAKKALGLTSRQSTPCSVGISRSYHENVIDHYDNPRNVGSFDKNDPSIGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKEKRVKANGVGESSQA

SEQ ID NO: 16539 - DNA, 477 bp, Brassica napus
  CDS (1)..(477)
atgatgatcaggcaagctgcgaagaaggctctagggattacgtcacgccaattaactccttgctccgtcggtatctttcgatcctaccatgagaacgtcatcgaccactacgacaatccccgcaacgtcggctctttcgataagaacgatcccaccgtcggcacgggtctcgtgggggctcccgcctgcggtgatgtaatgaagctgcaaatcaaggtcgatgagaagaccggtcaaatcgtcgatgctcgcttcaagacctttggttgtggctccgccatcgcctcttcatctgtcgccactgaatgggtgaaagggaaagctatggaggaagtcctgaccatcaagaacaccgaaatcgccaagcatctttctctcccacctgtgaagctccattgcagtatgttggcggaggacgccatcaaggcagctgtgaaagactacaaggataagcgtgtgaagacaaatggtgcttga

SEQ ID NO: 16540 - protein, 158 aa, Brassica napus
MMIRQAAKKALGITSRQLTPCSVGIFRSYHENVIDHYDNPRNVGSFDKNDPTVGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKDKRVKTNGA

SEQ ID NO: 16541 - DNA, 495 bp, Brassica napus
  CDS (1)..(495)
atgatgctcaggcaagctgcgaagaaggctctaggccttacgtcacgccaatcgacgccgtggtccgttggtatctcccgatcctaccacgagaacgtcatcgaccactacgacaacccccgcaacgtcgggtctttcgataagaacgataccagcatcggcacgggcctcgtcggagctcccgcgtgcggtgatgtgatgaagcttcagatcaaggtcgatgagaagaccggtcagatcgttgatgctcggttcaagacctttggttgtggctccgctatcgcctcttcatctgtggccactgaatgggtgaaaggcaaagctatggaggaagtcctgaccatcaagaacactgagattgcaaagcatctttctctcccaccagtgaagctccattgcagtatgttggcggaggacgccatcaaggcagctgtcaaagactacaaggagaagcgtttgaagacaaacggtgctggagaaacctcacaggcgtga

SEQ ID NO: 16542 - protein, 164 aa, Brassica napus
MMLRQAAKKALGLTSRQSTPWSVGISRSYHENVIDHYDNPRNVGSFDKNDTSIGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKEKRLKTNGAGETSQA

SEQ ID NO: 16543 - DNA, 495 bp, Brassica napus
  CDS (1)..(495)
atgatgctcaggcaagctgcgaagaaggctctaggccttacgtcacgccaatcgacgccgtggtccgttggtatctcccgatcctaccacgagaacgtcatcgaccactacgacaacccccgcaacgtcgggtctttcgataagaacgataccagcatcggcacgggcctcgtcggagctcccgcgtgcggtgatgtgatgaagcttcagatcaaggtcgatgagaagaccggtcagatcgttgatgctcggttcaagacctttggttgtggctccgctatcgcctcttcatctgtcgccactgaatgggtgaaaggcaaagctatggaggaagtcctgaccatcaaaaacactgagattgcaaagcatctttctctcccaccagtgaagctccattgcagtatgttggcggaggacgccatcaaggcagctgtgaaagactacaaggagaagcgtgtgaagacaaacggtgctggagaaacctcacaggcttga

SEQ ID NO: 16544 - protein, 164 aa, Brassica napus
MMLRQAAKKALGLTSRQSTPWSVGISRSYHENVIDHYDNPRNVGSFDKNDTSIGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKEKRVKTNGAGETSQA

SEQ ID NO: 16545 - DNA, 504 bp, Brassica napus
  CDS (1)..(504)
atgatgatcaggcaagctgcgaagaaggctctagggattacgtcacgccaatcaactccttgctccgtcggtatcttccgatcctaccatgagaacgtcatcgaccactacgacaatccccgcaacgtcggctctttcgataagaacgatcccaccgtcggcacgggtctcgtgggggctcccgcctgcggtgatgtaatgaagctgcaaatcaaggtcgatgagaagaccggtcaaatcatcgatgctcgcttcaagacctttggttgtggctccgccatcgcctcttcatctgtcgccactgaatgggtgaaagggaaagctatggaggaagtcctgaccatcaagaacaccgaaatcgccaagcatctttctctcccacctgtgaagctccattgcagtatgttggcggaggacgccatcaaggcagctgtgaaagactacaaggagaatcgtgtgaatacaaaggtgttgcacaaagctcacaggctaatttccttttga

SEQ ID NO: 16546 - protein, 167 aa, Brassica napus
MMIRQAAKKALGITSRQSTPCSVGIFRSYHENVIDHYDNPRNVGSFDKNDPTVGTGLVGAPACGDVMKLQIKVDEKTGQIIDARFKTFGCGSAIASSSVATEWVKGKAMEEVLTIKNTEIAKHLSLPPVKLHCSMLAEDAIKAAVKDYKENRVNTKVLHKAHRLISF

SEQ ID NO: 16547 - DNA, 519 bp, Zea mays
  CDS (1)..(519)
atgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacgcggacgtcggaacggggatcgtcggcgcgccggcgtgcggggacgtcatgaagctgcagatccgcgtcgacgaggggtccggcaggatcgtcgacgcgcgcttcaagaccttcggctgcggctccgccatcgcgtcctcctccgtcgcttccgaatgggtcaagggcaagcaagtggaggaagtggtagccatcaagaacaccgagattgcgaagcacctgtctcttccaccagtgaagctccactgcagcatgctcgctgaggacgcaatcaaggccgccgtgaaggattacgaggcaaagaaagggaagaagatggccaaggcagaggagcaggacaccccatgcccgtaa

SEQ ID NO: 16548 - protein, 172 aa, Zea mays
MMLRAAGRRLLGVGGGDPAPAVAAAVAASRSRGYHERVVDHYNNPRNVGSLDKDDADVGTGIVGAPACGDVMKLQIRVDEGSGRIVDARFKTFGCGSAIASSSVASEWVKGKQVEEVVAIKNTEIAKHLSLPPVKLHCSMLAEDAIKAAVKDYEAKKGKKMAKAEEQDTPCP

SEQ ID NO: 16549 - DNA, 498 bp, Glycine max
  CDS (1)..(498)
atgctgagagtgggcgcaaagaggcttttgggaacgacgtcgttgggcgttagggttccggcgaggctgtaccacgagagggttgtggatcactacgacaacccccggaacgttggatcgttagacaagaacgacccgagcgtggggacgggtttggtgggggcgccggcgtgcggcgacgtgatgaagctccagattaaggtcgacgacaaaaccggaaaaatcgtcgatgctcgattcaagactttcggttgtggctccgccattgcttcttcctccgtcgctactgagtgggtgaagggaaagcaaatggaggaagttctgactataaaaaatactgaaattgcaaagcatctttcacttccaccagttaagctccactgcagcatgcttgctgaagatgccatcaaagcagccgttaaagactatgaagctaagcgtgctaaggcaactgctagcggagaggcagcaacaggagagaagcctgccattgcatga

SEQ ID NO: 16550 - protein, 165 aa, Glycine max
MLRVGAKRLLGTTSLGVRVPARLYHERVVDHYDNPRNVGSLDKNDPSVGTGLVGAPACGDVMKLQIKVDDKTGKIVDARFKTFGCGSAIASSSVATEWVKGKQMEEVLTIKNTEIAKHLSLPPVKLHCSMLAEDAIKAAVKDYEAKRAKATASGEAATGEKPAIA

SEQ ID NO: 16551 - DNA, 519 bp, Glycine max
  CDS (1)..(519)
atgctgagaatcgctgctagcgcgaagacaattgttcgaacggcgtcgttggaggcgccaccattggggattagggttctgcctcggctctaccacgagagggtggtggaccactacgataacccccgcaacgttggatccttcgacaagaacgaccccaccgtcggaacgggtcttgtcggagcacccgcgtgtggtgacgtcatgaaactccagattaaggttgatgacaaaacggggaagatcgtcgatgctcgcttcaaaaccttcgggtgtggatccgctattgcttcctcctccgtcgctactgaatgggttaaggaaaagcaaatagaggaagttttgaccattaaaaacactgaaattgcaaagcatctttcacttccaccagtcaagcttcactgcagcatgcttgctgaggatgctataaaagcagctgttaaagattatgaagctaagcgtgcctcagcatctgctggtggacagactacaactggagagaaagctgccactgcttga

SEQ ID NO: 16552 - protein, 172 aa, Glycine max
MLRIAASAKTIVRTASLEAPPLGIRVLPRLYHERVVDHYDNPRNVGSFDKNDPTVGTGLVGAPACGDVMKLQIKVDDKTGKIVDARFKTFGCGSAIASSSVATEWVKEKQIEEVLTIKNTEIAKHLSLPPVKLHCSMLAEDAIKAAVKDYEAKRASASAGGQTTTGEKAATA

SEQ ID NO: 16553 - DNA, 498 bp, Glycine max
  CDS (1)..(498)
atgctgagagtgggcgcaaagagggttttggaaacgacgttgtttggggttagggttccggcgaggctgtaccacgagagggttgtggatcactacgacaacccccggaacgttggatcgtttgacaagaacgacccgagcgtggggacgggtttggtgggggccccggcgtgcggcgatgtgatgaagctccagattaaggtcgacgacaaaaccggaaaaatcgtcgatgctcgattcaaaactttcggctgtggctccgccattgcttcttcctccgtcgctactgagtgggtgaagggaaggcaaatggaggaagttctgactataaaaaatactgaaattgcaaagcatctttcacttccaccagttaagctccactgcagcatgcttgctgaagatgctatcaaagcggccgttaaagactatgaagctaagcgtgctaaggcaactgctagcggagaggcagcaacagaagagaagcctgccactgcatga

SEQ ID NO: 16554 - protein, 165 aa, Glycine max
MLRVGAKRVLETTLFGVRVPARLYHERVVDHYDNPRNVGSFDKNDPSVGTGLVGAPACGDVMKLQIKVDDKTGKIVDARFKTFGCGSAIASSSVATEWVKGRQMEEVLTIKNTEIAKHLSLPPVKLHCSMLAEDAIKAAVKDYEAKRAKATASGEAATEEKPATA

SEQ ID NO: 16555 - DNA, 519 bp, Glycine max
  CDS (1)..(519)
atgctgagaatcgctgctagcgcgaagacaattgttcgaacggggtcgttggaggcgccaccattggggattagggttctgcctcggctctaccacgagagggtggtggaccactacgataacccccgcaacgttggatccttcgacaagaacgaccccaccgtcggaacgggtcttgtcggagcacccgcgtgtggtgacgtcatgaaactccagattaaggttgatgacaaaacggggaagatcgtcgatgctcgcttcaaaaccttcgggtgtggatccgctattgcttcctcctccgtcgctactgaatgggttaaggaaaagcaaatagaggaagttttgaccattaaaaacactgaaattgcaaagcatctttcacttccaccagtcaagcttcactgcagcatgcttgctgaggatgctataaaagcagctgttaaagattatgaagctaagcgtgcctcagcatctgctggtggacagactacaactggagagaaagctgtcactgcttga

SEQ ID NO: 16556 - protein, 172 aa, Glycine max
MLRIAASAKTIVRTGSLEAPPLGIRVLPRLYHERVVDHYDNPRNVGSFDKNDPTVGTGLVGAPACGDVMKLQIKVDDKTGKIVDARFKTFGCGSAIASSSVATEWVKEKQIEEVLTIKNTEIAKHLSLPPVKLHCSMLAEDAIKAAVKDYEAKRASASAGGQTTTGEKAVTA

SEQ ID NO: 16557 - DNA, 543 bp, Zea mays
  CDS (1)..(543)
atgctgcgagcggcaggcaggcggctcctcgccccggggctccgtcggctcggactgggcacaggcgcctacggcgaggcgggccctgccgcggcggcggcgggggtgagggcgtaccacgagcgggtggtggaccactacaacaacccgcggaacgtaggttccttcgacaaggacgaccccaacgtcggcactgggttggtcggcgcgccagcctgcggcgacgtcatgaagctgcagatccgcgtcgacgagaactccggcaagatcgtcgacgcctgcttcaagacttttggctgcggctccgccatagcgtcctcgtccgtcgctactgaatgggtgaagggaaaaccaatggatgaagttttgacaatcaagaacacggagatcgcgaagcacttgtcccttccaccagtaaagctccattgcagcatgcttgccgaggatgcgattaaagctgctgtaaaagactacgaagccaagaagtcgaagatggggcagaagggtgaagacagcccttcagagaaggctgctgaagcatga

SEQ ID NO: 16558 - protein, 180 aa, Zea mays
MLRAAGRRLLAPGLRRLGLGTGAYGEAGPAAAAAGVRAYHERVVDHYNNPRNVGSFDKDDPNVGTGLVGAPACGDVMKLQIRVDENSGKIVDACFKTFGCGSAIASSSVATEWVKGKPMDEVLTIKNTEIAKHLSLPPVKLHCSMLAEDAIKAAVKDYEAKKSKMGQKGEDSPSEKAAEA

SEQ ID NO: 16559 - DNA, 519 bp, Zea mays
  CDS (1)..(519)
atgatgctgcgcgcggtgggcaggcgactcctcggcgtaggaggcggcgagccagcgcccacggtcgctgctgctgtggcggcgagcaggagcagaggataccacgagcgggtggtggaccactacaacaacccgcgcaacgtggggtccttggacaaggacgacgcggacgtcggaacggggatcgtcggcgcgccggcgtgcggggacgtcatgaagctgcagatccgcgtcgacgaggggtccggcaggatcgtcgacgcgcgcttcaagaccttcggctgcggctccgccatcgcgtcctcctccgtcgcttccgaatgggtcaagggcaagcaagtagaggaagtggtagccatcaagaacaccgagattgcgaagcacctgtctcttccaccagtgaagctccactgcagcatgctcgctgaggacgcaatcaaggccgccgtgaaggattacgaggcaaagaaagggaagaagatggccaaggcagaggagcaggacaccccatccccgtaa

SEQ ID NO: 16560 - protein, 172 aa, Zea mays
MMLRAVGRRLLGVGGGEPAPTVAAAVAASRSRGYHERVVDHYNNPRNVGSLDKDDADVGTGIVGAPACGDVMKLQIRVDEGSGRIVDARFKTFGCGSAIASSSVASEWVKGKQVEEVVAIKNTEIAKHLSLPPVKLHCSMLAEDAIKAAVKDYEAKKGKKMAKAEEQDTPSP

SEQ ID NO: 16561 - DNA, 543 bp, Zea mays
  CDS (1)..(543)
atgctgcgagcgggaggcaggcggctcctcgccccggggctccgtcggctcggcctgggcacaggcgcctccggcgaggcgggtcctgccgcggcggcggcgggggtgagggcgtaccacgagcgggtggtggaccactacaacaacccgcggaacgtaggttccttcgacaaggacgaccccaacgtcggcactgggttggtcggcgcgccagcctgcggcgacgtcatgaagctgcagatccgcgtcgacgagaactccggcaagatcgtcgacgcctgcttcaagacttttggctgcggctccgccatagcgtcctcgtccgtcgctactgaatgggtgaagggaaaaccaatggatgaagttttgacaatcaagaacacggagatcgcgaagcacttgtcccttccaccagtaaagctccattgcagcatgcttgccgaggatgcgattaaagctgctgtaaaagactacgaagccaagaagtcgaagatggggcagaagggtgaagacagcccttcagagaaggctgctgaagcatga

SEQ ID NO: 16562 - protein, 180 aa, Zea mays
MLRAGGRRLLAPGLRRLGLGTGASGEAGPAAAAAGVRAYHERVVDHYNNPRNVGSFDKDDPNVGTGLVGAPACGDVMKLQIRVDENSGKIVDACFKTFGCGSAIASSSVATEWVKGKPMDEVLTIKNTEIAKHLSLPPVKLHCSMLAEDAIKAAVKDYEAKKSKMGQKGEDSPSEKAAEA

SEQ ID NO: 16563 - DNA, 519 bp, Zea mays
  CDS (1)..(519)
atgatgctgcgcgcggtgggcaggcgactcctcggcgtaggaggcggcgagccagcgccctcggtcgctgctgctgtggcggcgagcaggagcagaggataccacgagcgggtggtggaccactacaacaacccgcgcaacgtggggtccttggacaaggacgacgcggacgtcggaacggggatcgtcggggcgccggcgtgcggggacgtcatgaagctgcagatccgcgtcgacgaggggtccggcaggatcgtcgacgcgcgcttcaagaccttcggctgcggctccgccatcgcgtcctcctccgtcgcttccgaatgggtcaagggcaagcaagtggaggaagtggtagccatcaagaacaccgagattgcgaagcacctgtctcttccaccagtgaagctccactgcagcatgctcgctgaggacgcaatcaaggccgccgtgaaggattacgaggcaaagaaagggaagaagatggccaaggcagaggagcaggacaccccatgcccgtaa

SEQ ID NO: 16564 - protein, 172 aa, Zea mays
MMLRAVGRRLLGVGGGEPAPSVAAAVAASRSRGYHERVVDHYNNPRNVGSLDKDDADVGTGIVGAPACGDVMKLQIRVDEGSGRIVDARFKTFGCGSAIASSSVASEWVKGKQVEEVVAIKNTEIAKHLSLPPVKLHCSMLAEDAIKAAVKDYEAKKGKKMAKAEEQDTPCP

SEQ ID NO: 16565 - DNA, 543 bp, Zea mays
  CDS (1)..(543)
atgctgcgcgcgggagctaggcagctccttgccccggggctccggcggctcggtctgggcaccggcgccgccggtcaggtgggcccggccgccgcggcggcggggatgagggcgtaccacgagcgggtggtggaccactacaacaacccgcggaacgtcggttccttcgacaaggaggaccccaacgtcggtactgggctggtcggcgcgccggcctgcggcgacgtcatgaagttgcagatccgcgtcgacgaggactccggtaaaatcgtcgacgcctgcttcaagacctttggctgcggctccgccatagcgtcctcgtccgtcgctactgaatgggtgaagggaaaaccaatggatgaagtcttgacaatcaagaatactgagattgcaaagcacttgtcccttccaccagtaaagctccattgcagcatgcttgcggaggatgccattaaagctgctgtgaaagactacgaagccaagaaggcgaagatggggcaaaagagtgaagacagtccatcagagaaagctgctgaagcatga

SEQ ID NO: 16566 - protein, 180 aa, Zea mays
MLRAGARQLLAPGLRRLGLGTGAAGQVGPAAAAAGMRAYHERVVDHYNNPRNVGSFDKEDPNVGTGLVGAPACGDVMKLQIRVDEDSGKIVDACFKTFGCGSAIASSSVATEWVKGKPMDEVLTIKNTEIAKHLSLPPVKLHCSMLAEDAIKAAVKDYEAKKAKMGQKSEDSPSEKAAEA

SEQ ID NO: 16567 - DNA, 23 bp, Artificial sequence
  primer
atgttcgccagactcgctaatcc

SEQ ID NO: 16568 - DNA, 23 bp, Artificial sequence
  primer
tcaatgcaaaacggaggggttcc

SEQ ID NO: 16569 - protein, 127 aa, Artificial sequence
  consensus sequence
  Variant (2)..(4): Xaa in position 2 to 4 is any amino acid
  Variant (6)..(6): Xaa in position 6 is any amino acid
  Variant (9)..(10): Xaa in position 9 to 10 is any amino acid
  Variant (17)..(22): Xaa in position 17 to 22 is any amino acid
  Variant (23)..(25): Xaa in position 23 to 25 is any or no amino acid
  Variant (27)..(27): Xaa in position 27 is any amino acid
  Variant (29)..(29): Xaa in position 29 is any amino acid
  Variant (40)..(40): Xaa in position 40 is any amino acid
  Variant (44)..(44): Xaa in position 44 is any amino acid
  Variant (46)..(49): Xaa in position 46 to 49 is any amino acid
  Variant (50)..(51): Xaa in position 50 to 51 is any or no amino acid
  Variant (53)..(53): Xaa in position 53 is any amino acid
  Variant (55)..(56): Xaa in position 55 to 56 is any amino acid
  Variant (60)..(60): Xaa in position 60 is any amino acid
  Variant (71)..(72): Xaa in position 71 to 72 is any amino acid
  Variant (75)..(76): Xaa in position 75 to 76 is any amino acid
  Variant (80)..(86): Xaa in position 80 to 86 is any amino acid
  Variant (88)..(88): Xaa in position 88 is any amino acid
  Variant (90)..(92): Xaa in position 90 to 92 is any amino acid
  Variant (94)..(95): Xaa in position 94 to 95 is any amino acid
  Variant (97)..(97): Xaa in position 97 is any amino acid
  Variant (98)..(98): Xaa in position 98 is any or no amino acid
  Variant (104)..(104): Xaa in position 104 is any amino acid
  Variant (108)..(108): Xaa in position 108 is any amino acid
  Variant (109)..(111): Xaa in position 109 to 111 is any or no amino acid
  Variant (119)..(119): Xaa in position 119 is any amino acid
  Variant (121)..(122): Xaa in position 121 to 122 is any amino acid
  Variant (125)..(125): Xaa in position 125 is any amino acid
  Variant (126)..(126): Xaa in position 126 is any or no amino acid
YXXXVXDHXXNPRNVGXXXXXXXXXGXGXVGAPACGDVMXLQIXVXXXXXXIXDXXFKTXGCGSAIASSSXXTEXXKGKXXXXXXXIXNXXXAXXLXXLPPVKXHCSXXXXLAEDAIKXAXXDYXXK

SEQ ID NO: 16570 - protein, 15 aa, Artificial sequence
  protein pattern
  Variant (6)..(6): Xaa in position 6 is Ile, Leu or Val
  Variant (10)..(10): Xaa in position 10 is Ile, Leu, Met or Val
LPPVKXHCSXLAEDA

SEQ ID NO: 16571 - protein, 10 aa, Artificial sequence
  protein pattern
  Variant (3)..(4): Xaa in position 3 to 4 is any amino acid
  Variant (9)..(9): Xaa in position 9 is Met or Val
DHXXNPRNXG

SEQ ID NO: 16572 - protein, 15 aa, Artificial sequence
  protein pattern
  Variant (2)..(2): Xaa in position 2 is Ile, Leu or Met
  Variant (7)..(7): Xaa in position 7 is Ala, Glu or Ser
  Variant (12)..(12): Xaa in position 12 is Ile or Met
  Variant (13)..(13): Xaa in position 13 is any amino acid
  Variant (15)..(15): Xaa in position 15 is Ala, Asp, Gln or Ser
GXVGAPXCGDVXXLX

SEQ ID NO: 16573 - DNA, 882 bp, SACCHAROMYCES CEREVISIAE
  CDS (1)..(882)
atgcatatgcaactcaggaaaagaaaaagggttgactattcagggagaaatcagacgtccgatcctccttcaaccacaacggcagcggtaccatccattattgtccctaagaagcgtaaagtagtcgcacaaaacatggttagtccagctattcgagccacaaccacaacactgggcacctcaaatataataatacctaagcctctgcagcgccctaaattccacaatagcgccagcctatcttcacctgatgatgatcccgaaaagatctctgtattggaagttcagaaaaatttgtccaatctcatcaaaagacaacaaagattattttataaagatatacataagccgactctcgccggcttgaaaaatttcgaaatgttaaggctgcccaatgatctaaaactcctacaaaacatcgtaaacctattatattcattcgagcaattaaacagtgactcgaagacaagaccagtcactacttccaaattaaaggcctcctctcaagcgcactcagacaaattgaaaaaaatgctagctgagaggaaacctccatttagccaccccagtcacagcggcactgcctaccacaatgacatcatccatgagatagcgaatttgcattctattaacctggtagatttgattaatttggaagtatataataacaattgccatacaaacaacacagcgttgcaaactacggcgaattcgctgacacttaatagcattatcaaaaagcttgacaagccaatactgaaagaaagaaataattctctggtatggccccataaaagcagatttaaagcaaaaaggaaccaaccttcgcctggccaatctttaattaacaatacagatataactctctacaacgatgtatag

SEQ ID NO: 16574 - protein, 293 aa, SACCHAROMYCES CEREVISIAE
MHMQLRKRKRVDYSGRNQTSDPPSTTTAAVPSIIVPKKRKVVAQNMVSPAIRATTTTLGTSNIIIPKPLQRPKFHNSASLSSPDDDPEKISVLEVQKNLSNLIKRQQRLFYKDIHKPTLAGLKNFEMLRLPNDLKLLQNIVNLLYSFEQLNSDSKTRPVTTSKLKASSQAHSDKLKKMLAERKPPFSHPSHSGTAYHNDIIHEIANLHSINLVDLINLEVYNNNCHTNNTALQTTANSLTLNSIIKKLDKPILKERNNSLVWPHKSRFKAKRNQPSPGQSLINNTDITLYNDV

SEQ ID NO: 16575 - DNA, 945 bp, Candida glabrata CBS 138
  CDS (1)..(945)
atggagttgcggaagcggaagaaagtcaactattctgagtcaaaaggaagaatcggtggtttaaagactgttgtggtacaacctgattctccaccacataatttcaataaagatgttaagcctaaaggtctaccacaaaagattgttagatacacccccatgataaataaaaggaaggcatcgaaaaggataaacaaacctacatcaaagaaagtgccacatgttatgggaaactatgataatagttgtcgtatcaaaaaattgacttttgaaagaccctcattcaacgactattcgaattataaacaaccagagcctgctctaacaggcttaattcattcagatgcccggatagattggataaatgccaaaaagtttcttgcaaaccatcgtgaaaagctaagaaagttagccaaatttcaatatgaactgtattacaaggacataaccaagccagaatacaaggggccacaggcatttgctagtctgaaactaccggacgacatggtatcttattccaatataataaagagtattgggtcattgctacatgaagttgaaaatttagaaactaacaaaaattctcaaaaattatacaaaccaactattgaaatttcagctgaagctttgaagaccatccgcgaacagacatcaaataatgacagaattgagcgtactgccgagttgcatgatattgatatcgaagatatcaaacaaatattaagaaagaacgaaataaacaccacattacatcaaatgaacatgcttaaatcgtcagatttccaaatcatgcacactttgatggaaaagaggtacttcccatatgatgattcatccttgctatggccaactaaatataaaaaagagctcaaaagatattcaagctcagaactggatcaaaatgatccgcttcaactttcaattccgttattcacggatttttga

SEQ ID NO: 16576 - protein, 314 aa, Candida glabrata CBS 138
MELRKRKKVNYSESKGRIGGLKTVVVQPDSPPHNFNKDVKPKGLPQKIVRYTPMINKRKASKRINKPTSKKVPHVMGNYDNSCRIKKLTFERPSFNDYSNYKQPEPALTGLIHSDARIDWINAKKFLANHREKLRKLAKFQYELYYKDITKPEYKGPQAFASLKLPDDMVSYSNIIKSIGSLLHEVENLETNKNSQKLYKPTIEISAEALKTIREQTSNNDRIERTAELHDIDIEDIKQILRKNEINTTLHQMNMLKSSDFQIMHTLMEKRYFPYDDSSLLWPTKYKKELKRYSSSELDQNDPLQLSIPLFTDF

SEQ ID NO: 16577 - DNA, 921 bp, Kluyveromyces lactis NRRL Y-1140
  CDS (1)..(921)
atgcagctgcgaagaagtacgcgtttacgcaccgtacatactgttaaaaataacacttccatcaatgaggatcacagtttgatttctgtgtcggatcaggtatcagagaaacctgaggacagatttgacaaagtagatcaggactcagatgatgatgaaaatggcgagcgtgtagcggttcaagacatttcctttgacgaggatgaacgaatgcagagcagaacaggtcaaacttccgctacgactcttttgaaaatctcaagacctgaatataacccacaagatttgaaggaaactattcatgttgatacgcattttgttaaccagtttaacgatttgatagagaaacaatctactttgtttttcaattccttgacaagtcctgaatacgttatatataataacttggaaatattcaaatatccaagtgataaggtgagcttgcaaacaatatcaagacagttgactgaattactaccagacttgaacaagaactacgataccgatctgaaagagctgttaaaacaattgcatgaggatcaagaacgagaggaaaacttgaaaattttaaatcaaggtccagaagctgaagtcttcaaagacccattacaatcgctactaaattatcaacctgatgtgaaagaatcagacgaatcaaaacttatagagcaagtggccaaaatccatgaaatcaacatttccgatatatctgacatccttatcaacccaccagtgcggacactgaagagagcattgaatgtgaacaaccaaacaaagaaacatgacatttcccatatttccaataaatgcagtagattattaacgaaagaacgcaaccattcattgccatggcccgttaagaagaaaaagaagcaaacagattcatcggcaatacatgaagatgtctcattaatgtcatga

SEQ ID NO: 16578 - protein, 306 aa, Kluyveromyces lactis NRRL Y-1140
MQLRRSTRLRTVHTVKNNTSINEDHSLISVSDQVSEKPEDRFDKVDQDSDDDENGERVAVQDISFDEDERMQSRTGQTSATTLLKISRPEYNPQDLKETIHVDTHFVNQFNDLIEKQSTLFFNSLTSPEYVIYNNLEIFKYPSDKVSLQTISRQLTELLPDLNKNYDTDLKELLKQLHEDQEREENLKILNQGPEAEVFKDPLQSLLNYQPDVKESDESKLIEQVAKIHEINISDISDILINPPVRTLKRALNVNNQTKKHDISHISNKCSRLLTKERNHSLPWPVKKKKKQTDSSAIHEDVSLMS

SEQ ID NO: 16579 - DNA, 25 bp, Artificial sequence
  primer
atgcatatgcaactcaggaaaagaa

SEQ ID NO: 16580 - DNA, 26 bp, Artificial sequence
  primer
ctatacatcgttgtagagagttatat

SEQ ID NO: 16581 - protein, 336 aa, Artificial sequence
  consensus sequence
  Variant (2)..(2): Xaa in position 2 is any amino acid
  Variant (5)..(27): Xaa in position 5 to 27 is any amino acid
  Variant (28)..(38): Xaa in position 28 to 38 is any or no amino acid
  Variant (40)..(91): Xaa in position 40 to 91 is any amino acid
  Variant (92)..(103): Xaa in position 92 to 103 is any or no amino acid
  Variant (105)..(121): Xaa in position 105 to 121 is any amino acid
  Variant (122)..(128): Xaa in position 122 to 128 is any or no amino acid
  Variant (130)..(133): Xaa in position 130 to 133 is any amino acid
  Variant (134)..(136): Xaa in position 134 to 136 is any or no amino acid
  Variant (138)..(140): Xaa in position 138 to 140 is any amino acid
  Variant (142)..(143): Xaa in position 142 to 143 is any amino acid
  Variant (145)..(151): Xaa in position 145 to 151 is any amino acid
  Variant (153)..(165): Xaa in position 153 to 165 is any amino acid
  Variant (167)..(167): Xaa in position 167 is any amino acid
  Variant (169)..(174): Xaa in position 169 to 174 is any amino acid
  Variant (176)..(190): Xaa in position 176 to 190 is any amino acid
  Variant (191)..(191): Xaa in position 191 is any or no amino acid
  Variant (193)..(210): Xaa in position 193 to 210 is any amino acid
  Variant (213)..(223): Xaa in position 213 to 223 is any amino acid
  Variant (224)..(245): Xaa in position 224 to 245 is any or no amino acid
  Variant (247)..(249): Xaa in position 247 to 249 is any amino acid
  Variant (251)..(252): Xaa in position 251 to 252 is any amino acid
  Variant (254)..(254): Xaa in position 254 is any amino acid
  Variant (256)..(258): Xaa in position 256 to 258 is any amino acid
  Variant (260)..(301): Xaa in position 260 to 301 is any amino acid
  Variant (302)..(304): Xaa in position 302 to 304 is any or no amino acid
  Variant (307)..(307): Xaa in position 307 is any amino acid
  Variant (310)..(310): Xaa in position 310 is any amino acid
  Variant (312)..(327): Xaa in position 312 to 327 is any amino acid
  Variant (328)..(335): Xaa in position 328 to 335 is any or no amino acid
MXLRXXXXXXXXXXXXXXXXXXXXXXXXXXXXXXXXXXVXXXXXXXXXXXXXXXXXXXXXXXXXXXXXXXXXXXXXXXXXXXXXXXXXXXXXXXXXXXXXXXXPXXXXXXXXXXXXXXXXXXXXXXXXNXXXXXXXLXXXQXXLXXXXXXXPXXXXXXXXXXXXXPXDXXXXXXIXXXXXXXXXXXXXXXXTXXXXXXXXXXXXXXXXXXLKXXXXXXXXXXXXXXXXXXXXXXXXXXXXXXXXXIXXXAXXHXIXXXDXXXXXXXXXXXXXXXXXXXXXXXXXXXXXXXXXXXXXXXXXXXXXSLXWPXKXXXXXXXXXXXXXXXXXXXXXXXXL

SEQ ID NO: 16582 - DNA, 558 bp, Saccharomyces cerevisiae
  CDS (1)..(558)
atgcaggctaaattattgtttaccagactaaactttagacgtccctccacaactttacgccagtttcccctaacatgttttttatttcatagcaaagcattttactcggatctggtcactaaggagccgttgatcacaccgaaaagaataataaataagacgcctgggttaaacttatctatttctgagagggcttccaacagactagctgagatctaccgcaatagtaaggaaaatttaagaattagtgtggaaagtggtggatgtcacggtttccagtacaatctaactctagaacccgctaccaagccagatattaagaatgatgtcaaagacaaggagttttcagacgaccttgacgatgatgattccaaggatataatatacgtgttacccgaagataagggtcgagtgataattgatagtaaatcactaaacattttgaataacactacactgacatacactaatgagttgatcggttcttcgttcaaaatcatcaatggtagcctaaaaagtagttgtggttgtggaagtagttttgatattgaaaattaa

SEQ ID NO: 16583 - protein, 185 aa, Saccharomyces cerevisiae
MQAKLLFTRLNFRRPSTTLRQFPLTCFLFHSKAFYSDLVTKEPLITPKRIINKTPGLNLSISERASNRLAEIYRNSKENLRISVESGGCHGFQYNLTLEPATKPDIKNDVKDKEFSDDLDDDDSKDIIYVLPEDKGRVIIDSKSLNILNNTTLTYTNELIGSSFKIINGSLKSSCGCGSSFDIEN

SEQ ID NO: 16584 - DNA, 483 bp, Plasmodium falciparum
  CDS (1)..(483)
atgttaaaatttttaagtacaaaatgcaaacagtttaattcattaaaccatataataaaacataaaatatatttcccttcaaaaagtaataaaagttatttttcttcttccgtaaaagatgtagagaaaaaaaacaaagaacctatcatacaattaacgaatgatgctataaataaaatgaaagaaataaatttaaagtataaaaattccaaagctttaaaagtttgtgtagaagcaggtgggtgctcaggatttcagtattctttttcattaattgataaaaataaaataaaagataaagaacaaatagtttatgataaagattgtattgtagtaatcgacaaacaagttattgatattttaaagaatagcaaaatacattacattaataatcttatatctaaaaagtttacaattgaaaatatacaaaatatttcctccaagtgttcatgtggaaattcctttgatattgactttgtataa

SEQ ID NO: 16585 - protein, 160 aa, Plasmodium falciparum
MLKFLSTKCKQFNSLNHIIKHKIYFPSKSNKSYFSSSVKDVEKKNKEPIIQLTNDAINKMKEINLKYKNSKALKVCVEAGGCSGFQYSFSLIDKNKIKDKEQIVYDKDCIVVIDKQVIDILKNSKIHYINNLISKKFTIENIQNISSKCSCGNSFDIDFV

SEQ ID NO: 16586 - DNA, 330 bp, Bradyrhizobium japonicum USDA 110
  CDS (1)..(330): transl_table=11
atgacgactgccgtgaccatcagtgaccgggccgcacgccggattggggagatcctcaagggcgaagggtcaggcgcgatgctgcgcatctcggtcgagggcggcggctgttccggctttcagtacaagttcgacatcgaccgcgaccgcaccgacgacgatctcgtgatcgagcaggacaatgcggtggtgctggtcgattccgcctcccagcctttcctggcgggatcgcaggtcgatttcgtggacgacctgatcggcgcctcgttccgcgtcaacaatcccaacgcgacggcgtcctgcggctgcgggaccagcttctcgatctga

SEQ ID NO: 16587 - protein, 109 aa, Bradyrhizobium japonicum USDA 110
MTTAVTISDRAARRIGEILKGEGSGAMLRISVEGGGCSGFQYKFDIDRDRTDDDLVIEQDNAVVLVDSASQPFLAGSQVDFVDDLIGASFRVNNPNATASCGCGTSFSI

SEQ ID NO: 16588 - DNA, 333 bp, Rhodopseudomonas palustris CGA009
  CDS (1)..(333): transl_table=11
atgacggaatcgagcgtcaccatcagcgaacgcgcggcgcgccggattggcgaaatcctcaagggcgaaggccaaggtgcgatgctgcggatcagcgtcgaaggcggcggttgctccggctttcagtacaaattcgacgtcgaccgcaccaagaccgacgacgatctggtgatcgccaaggaaggcgcggtggtgctggtcgattccgcctcggtgccgttcctcgccggctcggaagtcgacttcgtcgacgacctgatcggcgcctcgttccgggtcaacaacccgaacgcaaccgcctcctgcggctgcggcaccagcttctcgatctga

SEQ ID NO: 16589 - protein, 110 aa, Rhodopseudomonas palustris CGA009
MTESSVTISERAARRIGEILKGEGQGAMLRISVEGGGCSGFQYKFDVDRTKTDDDLVIAKEGAVVLVDSASVPFLAGSEVDFVDDLIGASFRVNNPNATASCGCGTSFSI

SEQ ID NO: 16590 - DNA, 462 bp, Wolbachia endosymbiont of Drosophila melanogaster
  CDS (1)..(462): transl_table=11
atgtcaacaaattacaacatcaacttaactgataatgcactaaaaaaaatccactctcttgcagagcaggaaggggataagagttccattttacgggttgcagtttcaggtggtggatgttctggcttcaaatacaattttcttatggatcaaatgaataaaaatctacctttggatgatgaagacgatgattacgatgatgagtttgatgacgaagacgaagatgatgactatgaagaaagtgaggactatagaagccactccagttttagcgaaaaaggtaaagatatagtaattaatgatgaaaatggaaaccctgtattaatggttgataattgttcagcaaaatttttaaataactcagttatagattatactgaggatctcagtggttctggttttcaaataaagaatgcctttgctaagtctcaatgtggttgtggtaacagtttttcggtttaa

SEQ ID NO: 16591 - protein, 153 aa, Wolbachia endosymbiont of Drosophila melanogaster
MSTNYNINLTDNALKKIHSLAEQEGDKSSILRVAVSGGGCSGFKYNFLMDQMNKNLPLDDEDDDYDDEFDDEDEDDDYEESEDYRSHSSFSEKGKDIVINDENGNPVLMVDNCSAKFLNNSVIDYTEDLSGSGFQIKNAFAKSQCGCGNSFSV

SEQ ID NO: 16592 - DNA, 489 bp, Chlamydomonas reinhardtii
  CDS (1)..(489)
atgttggtccaccggcagtgcacgccagtgcgggtccagccgccgaagcacctggcacggcgagctgtgctgctccctgcacgtcgtggtgtcgcggtggcgcgtgcagaagctgctccagggctagtggcgacggaggcgcccccgcacgccatcacgctgacgccagaggccctcgtgcagctgcgcaagctgcgcgcagactttaaggaacagagcgaggccatgctgctgcgcgtgggcgtgaagcaaggcggctgctcgggtatgtcgtacgtgatggacttcgagtctcaggacaaggtgacggacgacgaccacgtcatctcgtacgatgacggcttccgcctggtggtggaccccaagtcgctgctgtacctgttcggcatgcagctgggctactccacggcgctcatcggcggcggcttccagttccagaaccccaacgccaccgactcgtgcggctgcggcaagtcctttggcgtgtag

SEQ ID NO: 16593 - protein, 162 aa, Chlamydomonas reinhardtii
MLVHRQCTPVRVQPPKHLARRAVLLPARRGVAVARAEAAPGLVATEAPPHAITLTPEALVQLRKLRADFKEQSEAMLLRVGVKQGGCSGMSYVMDFESQDKVTDDDHVISYDDGFRLVVDPKSLLYLFGMQLGYSTALIGGGFQFQNPNATDSCGCGKSFGV

SEQ ID NO: 16594 - DNA, 714 bp, Gibberella zeae PH-1
  CDS (1)..(714)
atggctcgagttcactgcgctaatgcgcaatccaccgtcaattcctttatgcaacttgcaagacgaagctacacgaccgccactgctcaatcctcagcacccctcgagtttcttgtcccgagatgtactccgccaaccggcttgcgaacttctggacttgcgattaaccgctccagaacatatgcccactcaagatggtcatggagttataaattacgagaaacagcgacgcgacagttctcaacatcggctgtacgacaaaagacacgggcgatactgaacccccaacaagacgaagatggcaacgaaatgatgctcgaaattactgaccgggctgccaagcgcctcaacaagatcatggagaaggatggtaacccaaaccttgctttgagaatccaagtggaaagcggtggctgtcatggcttccaatacctcatgagtctcgtcaccttaccagctaaggatgccgccgaatggtcctcaatcgtgaacgaagacgatacgattttccaatacatctccgaagacgctgatccggccacagcttcggaggatggtccgaagattatactcgatgaaccatccctcgacctcctcaagggcagcaaagttgacttcacgatggagctgatcggctcgcagttcaagattacagacaacccgcttgctaccagcagttgtggctgtggtacaagcttcgatatcaagatgtag

SEQ ID NO: 16595 - protein, 237 aa, Gibberella zeae PH-1
MARVHCANAQSTVNSFMQLARRSYTTATAQSSAPLEFLVPRCTPPTGLRTSGLAINRSRTYAHSRWSWSYKLRETATRQFSTSAVRQKTRAILNPQQDEDGNEMMLEITDRAAKRLNKIMEKDGNPNLALRIQVESGGCHGFQYLMSLVTLPAKDAAEWSSIVNEDDTIFQYISEDADPATASEDGPKIILDEPSLDLLKGSKVDFTMELIGSQFKITDNPLATSSCGCGTSFDIKM

SEQ ID NO: 16596 - DNA, 681 bp, Candida glabrata CBS 138
  CDS (1)..(681)
atgcgggatagtgtaacactcgacaagacggcggttaagatgatcgggatcaggagcgtgacggtatcgaggatttctgtgaggggatatgcgcgtgtggtttctatgccgaaggtgattccgatggctaaggcgatggccaagcctatggcgaagcccatgatgaatacaatgcagaatacccgttggtatgggataaaagttgaggcatctgaaggtgaggttccgctggtggaaccttacaaggttttaaacaagcaggaggacaagggcttgaagatagcggagagggctgcaaagagattaaatgagatatacaaggaatcccaagaggtgttgcgtgtgcttgtggagagcggtggctgtcacgggtttcaatacaacatgaagctagtgccggagtcgacgctttccttggaggaaactggcaattccgaaagcaaaacgcaggaagaagtagtagatgagtttgcagaaggtgctgactcgtctagtaaagacgtcatatatatagtctcggaagaaggcgggaaagttgcaatagacgagacttcgctcgggatactgaacaacactactctgaactataccactgagctaatcggttcgactttcaagatcacagatggtaacttgaagagcagttgtgggtgtggttcgagttttgatatcgaaaaatga

SEQ ID NO: 16597 - protein, 226 aa, Candida glabrata CBS 138
MRDSVTLDKTAVKMIGIRSVTVSRISVRGYARVVSMPKVIPMAKAMAKPMAKPMMNTMQNTRWYGIKVEASEGEVPLVEPYKVLNKQEDKGLKIAERAAKRLNEIYKESQEVLRVLVESGGCHGFQYNMKLVPESTLSLEETGNSESKTQEEVVDEFAEGADSSSKDVIYIVSEEGGKVAIDETSLGILNNTTLNYTTELIGSTFKITDGNLKSSCGCGSSFDIEK

SEQ ID NO: 16598 - DNA, 573 bp, Kluyveromyces lactis NRRL Y-1140
  CDS (1)..(573)
atgtggccagtacgactattaccatattctaggactcctttgacgcttgcaccccggatactgaaccaggtccccgttagagctgccttgggagtacgctggcaatcatcatcaccatcatcgatattggatactccgatcagaccagcaaagattattaatgaagtaccggatctgcattttagcatcaccaacagagcttccaagagactggctgagatatacaaggcttcaaaagagattcttagggtgacggttgaatctggtggatgtcacggatttcagtacaatttgaagctggtaccggaatctgacaagaaaatcggtaaccaggaacaagaaaccgatgacctgaatgacgaagatgattttgagactgttaaggatatcgtttatgtattacctgattccatcggcgaagttgttattgatgagcagtccctaaagattttgaacgataccactctcacatatagtaccgaattaatcggttccactttcaagattactggaggaagtatgaccagtagttgtggatgcggtagcagtttcggtttagaccaggaaacatga

SEQ ID NO: 16599 - protein, 190 aa, Kluyveromyces lactis NRRL Y-1140
MWPVRLLPYSRTPLTLAPRILNQVPVRAALGVRWQSSSPSSILDTPIRPAKIINEVPDLHFSITNRASKRLAEIYKASKEILRVTVESGGCHGFQYNLKLVPESDKKIGNQEQETDDLNDEDDFETVKDIVYVLPDSIGEVVIDEQSLKILNDTTLTYSTELIGSTFKITGGSMTSSCGCGSSFGLDQET

SEQ ID NO: 16600 - DNA, 678 bp, Debaryomyces hansenii CBS767
  CDS (1)..(678): transl_table=12
atgatttcaaagtttatacagagaaatgtagtaataccaactaccagacagttaatcaggcctagcatgacgtacttaacttacagacacggatattcaaccgaaacaggtacaaaatcaaatacagcacctaaagcatttaaatcctcgtcgttcaatcaaccaaaagagatccctaaggcatcaacgagtcaaacgcaaactgctgaagtaccccaagaagatattgatgattttaacataacgaagttgatccatggaactacggacatgaagatcgcaataactaagagggccagtaataaactaacgagtattgctgaagacgataagaatcctaatgctgcgttaaaagttgaggtcgaaagtggtgggtgtcatggatttcaatacaatttaaagttgactgacttgactgaagaattgaaagatgagaacaatgagcttttggttttcaaaagaatgggtgatgatggcgaggtagcgcaagttgtattagatgattcttcattacagattcttcaagactcgaaagttgactatacaaaagaattaattggtagtcagttcaaaattgttgactcaccgtacacttctacggcttgtggttgtggtgcatcctttgattttgattttgaaaagttagaaaaagtaagggagagagaagctaataagtaa

SEQ ID NO: 16601 - protein, 225 aa, Debaryomyces hansenii CBS767
MISKFIQRNVVIPTTRQLIRPSMTYLTYRHGYSTETGTKSNTAPKAFKSSSFNQPKEIPKASTSQTQTAEVPQEDIDDFNITKLIHGTTDMKIAITKRASNKLTSIAEDDKNPNAALKVEVESGGCHGFQYNLKLTDLTEELKDENNELLVFKRMGDDGEVAQVVLDDSSLQILQDSKVDYTKELIGSQFKIVDSPYTSTACGCGASFDFDFEKLEKVREREANK

SEQ ID NO: 16602 - DNA, 555 bp, Yarrowia lipolytica CLIB122
  CDS (1)..(555)
atgttcagacgactgttacaagccaagagctcgttgcggactgtcccccgactgggctccccgtcgctactgacacaaagacacttcacagcatccgcccgacgtcttttcgagtttcccgagtcggtcccccgagagaaaatcgaggaagatgccgtcaccattgtgaacccccagaaggacgacaagggacgactcctgcgtctgtttgtgtccgaccgagcggccaccagactcaacgccatttccgaggacgacaagaaccctttgctggctctccgaattgaggtggagtccggtggatgccatggcttccaatacaagctggagctgtccgacgtggaggacgtcgattttgagatggacagtgtgttcgagaagaacggcgctcgaattctcattgacaagagctctctggagattctgcgagaatccaacattgattacacaaccgagcttattggcagccagttcaaggtggtggacagtccctacactgtgagtgcttgtggctgcggctcctccttcgacttcgacgaaagcaagttggcctaa

SEQ ID NO: 16603 - protein, 184 aa, Yarrowia lipolytica CLIB122
MFRRLLQAKSSLRTVPRLGSPSLLTQRHFTASARRLFEFPESVPREKIEEDAVTIVNPQKDDKGRLLRLFVSDRAATRLNAISEDDKNPLLALRIEVESGGCHGFQYKLELSDVEDVDFEMDSVFEKNGARILIDKSSLEILRESNIDYTTELIGSQFKVVDSPYTVSACGCGSSFDFDESKLA

SEQ ID NO: 16604 - DNA, 699 bp, Candida albicans SC5314
  CDS (1)..(699): transl_table=12
atgttaggaacaaaatattttgctatatccaaacgaatcttaacattaaaatcatttaaacccttaacacttggtggtacaactattattactttacgttataattcgactaaaccaagtactaccaccaccaattctaatgctaattcatctaggctaaaaccgtcatcatttgccttcccatcgtctccaacttctcaacaatcatcatctacaactacttcaaccaatgattccataacatcatcacaacaacaagaagatattaatgatttcagagcaacaaaattaattcatggaaaaacaaatttatcatttgcaataactgaaagagctagtaagaaattaaatgaaatttctcaacaagataatcaagattcaggattattaatacaagtagaaagtggaggatgtcatggatttcaatataatttgaaattaaccaatattgataaagaattacaacaacaacaagacggcgatgctaatgatttggttgtgtttgaaagagatcaaggagggaaagtgattatgaatgaatcatcattaatgattttacaagattcaaaattggattatactaaagaattaattggtagtcaatttaaaattgttgatagtccttatactagttctgcttgtggttgtggaagttcatttgattttgattttgataaattgctgcaaaaggaaggataa

SEQ ID NO: 16605 - protein, 232 aa, Candida albicans SC5314
MLGTKYFAISKRILTLKSFKPLTLGGTTIITLRYNSTKPSTTTTNSNANSSRLKPSSFAFPSSPTSQQSSSTTTSTNDSITSSQQQEDINDFRATKLIHGKTNLSFAITERASKKLNEISQQDNQDSGLLIQVESGGCHGFQYNLKLTNIDKELQQQQDGDANDLVVFERDQGGKVIMNESSLMILQDSKLDYTKELIGSQFKIVDSPYTSSACGCGSSFDFDFDKLSQKEG

SEQ ID NO: 16606 - DNA, 342 bp, Bradyrhizobium sp. ORS278
  CDS (1)..(342): transl_table=11
atgaccaatgcctcgaccggccccgtcaccatcagcgagcgcgccgcccgccgcatcggcgagatcctcggcaaggagagcgccggtgcgatgctgcgcatctccgtcgagggcggcggctgctctggcttccagtacaagttcgacatcgaccgcgccaaggccgaggacgatctggtgatcgcccgcgacaaggccgtcgtgctggtcgatccggcctcggtgccgttcctggccggctcggaagtcgatttcgtcgacgacctgatgggcgcctcgttccggatcaacaatcccaacgccaccgcctcctgcggctgcggcaccagcttctcggtctga

SEQ ID NO: 16607 - protein, 113 aa, Bradyrhizobium sp. ORS278
MTNASTGPVTISERAARRIGEILGKESAGAMLRISVEGGGCSGFQYKFDIDRAKAEDDLVIARDKAVVLVDPASVPFLAGSEVDFVDDLMGASFRINNPNATASCGCGTSFSV

SEQ ID NO: 16608 - DNA, 324 bp, Bartonella quintana str. Toulouse
  CDS (1)..(324): transl_table=11
atgaatgtgaatatttcagatgttgctgccaagcgtattgcacagatacttttgagtgaaaccgataaaataggattacgtatttccgttgaagggggtgggtgttcaggcttttcttataaatataatttggtttctgaaacgagtgaagatgatctcgttcttaaaaaagatggggcagttgtgttcattgattcgctatcacttccttttatggaaggcgctgaaattgattttgttgatgatcttatgggacagtcttttcaaattcataatcctaatgctgtctcatcgtgcggttgcggtgtgagtttttcaatttaa

SEQ ID NO: 16609 - protein, 107 aa, Bartonella quintana str. Toulouse
MNVNISDVAAKRIAQILLSETDKIGLRISVEGGGCSGFSYKYNLVSETSEDDLVLKKDGAVVFIDSLSLPFMEGAEIDFVDDLMGQSFQIHNPNAVSSCGCGVSFSI

SEQ ID NO: 16610 - DNA, 324 bp, Silicibacter pomeroyi DSS-3
  CDS (1)..(324): transl_table=11
atgcgcctgccccccaaagtgactgaccgcgcctttgcccggctggccgagatcggcgccgcggatcagggccaggcgctgcgcgtcgcggtcgaaggcggcggctgttccggctttcaatacgagatcgcgctggatgcgcccaagtccgacgacctggtgcttgagggtcagggtcagcgggtggtggtcgatgcggtgtcgctgccgtttctggaaaacgccgtcatcgacttctccgaagagctgatcggcgcgcggtttgtgatcgacaatccgaatgccaccgcctcgtgcggctgcggcacctcgttctcgatctga

SEQ ID NO: 16611 - protein, 107 aa, Silicibacter pomeroyi DSS-3
MRLPPKVTDRAFARLAEIGAADQGQALRVAVEGGGCSGFQYEIALDAPKSDDLVLEGQGQRVVVDAVSLPFLENAVIDFSEELIGARFVIDNPNATASCGCGTSFSI

SEQ ID NO: 16612 - DNA, 447 bp, Anaplasma phagocytophilum HZ
  CDS (1)..(447): transl_table=11
atgtacggtatagaaagttatgggttgactataactggtggtgcggtcaataaaataaagtctgtcttagaaagagagggacatccgtctttgctgaggttatctgtgcagggtggtggctgtgctgggtttaagtatgagttcactactgagagtattagagatggccttattggtagaagtgatggtgatgatgactcagagtttgacatagatgatgaggaagaagaggaggatgaagatgggcatgatgaggtgcgaggagggtctgatctcgtgctttcagatgactctggcgctcctattttgctgattgatcgtcattctaagaagtttctgaagaactccactatagactatgtagaagatatgaatgggtcaaggttcgtggtgaataaccctggtgtaaagtttggttgtggctgtgggaacagtttttcgttgtga

SEQ ID NO: 16613 - protein, 148 aa, Anaplasma phagocytophilum HZ
MYGIESYGLTITGGAVNKIKSVLEREGHPSLLRLSVQGGGCAGFKYEFTTESIRDGLIGRSDGDDDSEFDIDDEEEEEDEDGHDEVRGGSDLVLSDDSGAPILLIDRHSKKFLKNSTIDYVEDMNGSRFVVNNPGVKFGCGCGNSFSL

SEQ ID NO: 16614 - DNA, 324 bp, Silicibacter sp. TM1040
  CDS (1)..(324): transl_table=11
atgcaactgcccccaaaagtgacggatcgcgcctttgaccggctcgccgaaatcggcgctgcagatcaaggccaggccctgcgcatcgcggtcgaaggcggcggttgctcgggctttcaatatgagattgcgctcgacacgcccaaatccgacgacctggtgcttgagggcaaaggccagaaagtcgtggtcgatgaaatctcgctgccgtttctcgagaatgccgtgatcgacttcaccgaagagctgatcggcgcgcgctttacgatcgaaaaccccaatgccacctccagctgtggctgcggcacctcgttttccatgtga

SEQ ID NO: 16615 - protein, 107 aa, Silicibacter sp. TM1040
MQLPPKVTDRAFDRLAEIGAADQGQALRIAVEGGGCSGFQYEIALDTPKSDDLVLEGKGQKVVVDEISLPFLENAVIDFTEELIGARFTIENPNATSSCGCGTSFSM

SEQ ID NO: 16616 - DNA, 324 bp, Roseovarius nubinhibens ISM
  CDS (1)..(324): transl_table=11
atgcaactgcctcccaaagtcaccgaccgcgcctttgaacgcctcgccgagatcggcgccggcgcccagggtcaggccctgcgcgtcgcggtcgaaggcggcggctgttccggctttcaatatgagatcaagctcgacgcgcccgaggccgatgacctcgtgctcgagggtcagggcgaacgggtcgtggtcgatgccgtgtcgctgccctttctcactggggcgaccatcgactttaccgaggaactgattggcgcgcggttcatcatcgacaaccccaacgccagcagctcctgcggctgcggcacgtccttctctatgtaa

SEQ ID NO: 16617 - protein, 107 aa, Roseovarius nubinhibens ISM
MQLPPKVTDRAFERLAEIGAGAQGQALRVAVEGGGCSGFQYEIKLDAPEADDLVLEGQGERVVVDAVSLPFLTGATIDFTEELIGARFIIDNPNASSSCGCGTSFSM

SEQ ID NO: 16618 - DNA, 459 bp, Ostreococcus tauri
  CDS (1)..(459)
atgcgtcgcgcgctcgcgcgcatcgccgcgcgcgcgagtgcgcgcgcgacgccgcgcgcgcggacgtcgcgcgaggggagattcgcatcgaatgcgatcggtgccgacgccgacgacggcgtcacgctcacggacgcgtgcgccgcgcgcgtgcgcgcgctcgagcgcgaggagggcggggcgacgcgcctgcggttggcggtccgggggggggggtgctcggggttcacgtacgagttcaccctcgagcgcggcgcgagggctggggcggatgacaagacgtttcgagcggcgaacggggcggaggtggtcgtggacggcgtctcgtacgagtacgtcaagggaagcacgattgattacgtggaggagatgataaagagctcgtttgaggtggtgaagaatccgagggcgaaagggagctgtgggtgcggggcgtcgttcgacgcggaggacgcgtga

SEQ ID NO: 16619 - protein, 152 aa, Ostreococcus tauri
MRRALARIAARASARATPRARTSREGRFASNAIGADADDGVTLTDACAARVRALEREEGGATRLRLAVRGGGCSGFTYEFTLERGARAGADDKTFRAANGAEVVVDGVSYEYVKGSTIDYVEEMIKSSFEVVKNPRAKGSCGCGASFDAEDA

SEQ ID NO: 16620 - DNA, 348 bp, Buchnera aphidicola subsp
  CDS (1)..(348): transl_table=11
atgaaaaataatatatctaaatttcccttatcattttcgaaatcagcaataaaaaaaataaaaactattattagtgaaaaaaacattcctaatttaaagtttagagtttatatcgcaggaggcgggtgtagtggttttcaatataaatttaaatttgataaaaataaaaataaaaatgatactatagttaatatattcaataatataataatcattgaccctataagtttacaatatcttcggggaggtcaaatagattatatagaaaatttagaaggatcaaaatttattatactaaatccaaaagcaaaacatacttgcgggtgcggatcttcatttagcatctaa

SEQ ID NO: 16621 - protein, 115 aa, Buchnera aphidicola subsp
MKNNISKFPLSFSKSAIKKIKTIISEKNIPNLKFRVYIAGGGCSGFQYKFKFDKNKNKNDTIVNIFNNIIIIDPISLQYLRGGQIDYIENLEGSKFIILNPKAKHTCGCGSSFSI

SEQ ID NO: 16622 - DNA, 618 bp, Schizosaccharomyces pombe
  CDS (1)..(618)
atgcttatgaaatcgcgagtaaacttattgtttaaaggaccatttttctttcgagaacgttgttttcaaacactcttaaatcctgtgatcgcaattcgacagctatcgcatggatcgcttagaaattctcgatcatgtagaattgatgcgaaatcgaatacattaacgaaagaaatatttcccaaaataaataatgaattcaaaatcaaaaatcgattttatagctcaaagcttgcgaacgaccaattcacgcttcaagagcaatgtgacgagaagggaatcccttttattttatacgtgaaagattcagcgaaaaaacagttagaaaaaattgcagaaaggaaaccagaagaaaactctgttttgcgcgtcactgtcgatggtggtggatgccatggatatcaagtatcttttcgcatggacaacaaaattggaaatgctgacacggtatttgtgcgtggaaaagccagggttgttgctgacaacatttcattacctttgataagtggctctgaaattgagtatacaaatgaacttattggttcctcttttcaacttttaaacaatccacgtgccaagacttcttgtggttgtaatgtcagttttgatgttgaatga

SEQ ID NO: 16623 - protein, 205 aa, Schizosaccharomyces pombe
MLMKSRVNLLFKGPFFFRERCFQTLLNPVIAIRQLSHGSLRNSRSCRIDAKSNTLTKEIFPKINNEFKIKNRFYSSKLANDQFTLQEQCDEKGIPFILYVKDSAKKQLEKIAERKPEENSVLRVTVDGGGCHGYQVSFRMDNKIGNADTVFVRGKARVVADNISLPLISGSEIEYTNELIGSSFQLLNNPRAKTSCGCNVSFDVE

SEQ ID NO: 16624 - DNA, 26 bp, Artificial sequence
  primer
atgcaggctaaattattgtttaccag

SEQ ID NO: 16625 - DNA, 28 bp, Artificial sequence
  primer
ttaattttcaatatcaaaactacttcca

SEQ ID NO: 16626 - protein, 142 aa, Artificial sequence
  consensus sequence
  Variant (2)..(7): Xaa in position 2 to 7 is any amino acid
  Variant (9)..(15): Xaa in position 9 to 15 is any amino acid
  Variant (16)..(20): Xaa in position 16 to 20 is any or no amino acid
  Variant (23)..(24): Xaa in position 23 to 24 is any amino acid
  Variant (26)..(27): Xaa in position 26 to 27 is any amino acid
  Variant (31)..(31): Xaa in position 31 is any amino acid
  Variant (34)..(34): Xaa in position 34 is any amino acid
  Variant (36)..(58): Xaa in position 36 to 58 is any amino acid
  Variant (59)..(100): Xaa in position 59 to 100 is any or no amino acid
  Variant (102)..(103): Xaa in position 102 to 103 is any amino acid
  Variant (105)..(107): Xaa in position 105 to 107 is any amino acid
  Variant (109)..(118): Xaa in position 109 to 118 is any amino acid
  Variant (120)..(120): Xaa in position 120 is any amino acid
  Variant (122)..(123): Xaa in position 122 to 123 is any amino acid
  Variant (125)..(134): Xaa in position 125 to 134 is any amino acid
  Variant (135)..(135): Xaa in position 135 is any or no amino acid
  Variant (140)..(140): Xaa in position 140 is any amino acid
AXXXXXXIXXXXXXXXXXXXLRXXVXXGGCXGFXYXXXXXXXXXXXXXXXXXXXXXXXXXXXXXXXXXXXXXXXXXXXXXXXXXXXXXXXXXXXXXXXXXDXXSXXXLXXXXXXXXXXLXGXXFXXXXXXXXXXXCGCGXSF

SEQ ID NO: 16627 - protein, 15 aa, Artificial sequence
  protein pattern
  Variant (2)..(2): Xaa in position 2 is Lys or Arg
  Variant (3)..(3): Xaa in position 3 is Ile, Leu or Val
  Variant (4)..(4): Xaa in position 4 is any amino acid
  Variant (6)..(6): Xaa in position 6 is Glu, Gln, Arg or Ser
  Variant (7)..(7): Xaa in position 7 is Ala, Gly or Ser
  Variant (11)..(11): Xaa in position 11 is any amino acid
  Variant (14)..(14): Xaa in position 14 is any amino acid
LXXXVXXGGCXGFXY

SEQ ID NO: 16628 - protein, 10 aa, Artificial sequence
  protein pattern
  Variant (2)..(2): Xaa in position 2 is any or no amino acid
  Variant (6)..(6): Xaa in position 6 is Gly or Asn
  Variant (7)..(7): Xaa in position 7 is any amino acid
  Variant (10)..(10): Xaa in position 10 is Asp, Gly or Ser
SXCGCXXSFX

SEQ ID NO: 16629 - DNA, 786 bp, Saccharomyces cerevisiae
  CDS (1)..(786)
atgactgccagcacatcagttgcggtgggttgtgcggtgggtatacccgtcggtgtaggtattataatagcagtatgtttctggtttaacctacaaaaaagatacaagagggaggaacaagacgatagagaattggaaagggctatttatgatgaaagtggtttcgtgtcctttgacaattttggacccttaagagacagtaaagatgaagcagcactagccagctccgagctaaaaaatcctgatcacacttctggttcatcggaaggatctgctcatccagaagaaaaagatggaaaatcgcgagatcaagagaaaccgttagggaaaaagaatagtaaatactatgtgccagcataccgtaggaaaataaatttacttcaagtacgaaataataactacggcaataatgccaggcagaagtccgttgtggatttaccaagtataaataacagctccaatgtttccttatcatcttcccaacggcatataacaaagagacagatcagcgtttatgatcagatggtccctgttatttctgatgaaggaccaaactttttcgcagatccttccagtgatactaatactagcaatgaccaaaacaaagcttcgatgatagaacttaaacataatactcgccaatctagtaatgaaaatctgataagaaatttgcagaatcaggactttggttcgtattacccaaggagagcttcatcctcgtttttaacatggcaattcccggggatcagctcgaatttccccgatcgttcaaacatttggcaataa

SEQ ID NO: 16630 - protein, 261 aa, Saccharomyces cerevisiae
MTASTSVAVGCAVGIPVGVGIIIAVCFWFNLQKRYKREEQDDRELERAIYDESGFVSFDNFGPLRDSKDEAALASSELKNPDHTSGSSEGSAHPEEKDGKSRDQEKPLGKKNSKYYVPAYRRKINLLQVRNNNYGNNARQKSVVDLPSINNSSNVSLSSSQRHITKRQISVYDQMVPVISDEGPNFFADPSSDTNTSNDQNKASMIELKHNTRQSSNENLIRNLQNQDFGSYYPRRASSSFLTWQFPGISSNFPDRSNIWQ

SEQ ID NO: 16631 - DNA, 1077 bp, Saccharomyces pastorianus
  CDS (1)..(1077)
atggcgaatactacgtctgtcgcagtcggttgtgcggtgggtatacccattggtgtgggtattatagtagcagtagtgttttggtttaacctacaaaaaagatataaggaggaagagaagaacgataaagaattggagagagcaatatacgatgaaagtggttttgtatcctttgacaattttggacccttacgagacagtaaagacgatgcaggattaaccagtgcggagttgaaaaatcctgatcacacatcgggttcatcagaaggatctgctcatccagaagagaaaaacgatggtaaatcacaagaactagagcacccgctggccaaaaaaaacagtaaatactatgttccagcatatcgtagaaaaataaatttactgcaagtacgaagtaataactacaataataaagccaagcagaaatctatcgtggatttaccgagtatgaacaacagttccaatgtctcactgtcatcctcccaacagcacataacgaaaagacaaatcagtgtttatgatcagatggtccctgtcattgctgatgaaggagcgaattttttttcagacccttcgagtgataacgctaatatcaataatgtccaaaacaaaccttcagtggtagaacttaaaaataatgctcgccaatctagtaatgagaatctaataaaaaatttacaaaaccaggactttggttcgtattacccaagaagagcttcatcctcgaatttgaatggcaatatatcaaatgcatcgtttcatacaagggattcctccataacatctgtaaacaaagtggatgcactagaggatgtatttgcgacgcccaaaagtggagctttgtcacaattaccaagcacgttcgacaaaaataatgaagagtcagatgattgtcgttcagttaatgacgacaaggtagtcacaacggacaaagacaatggggacttgtataaactgcagaataattacgacatgagcaacattggggaaattgctgaggaagatcaatacgaaaatgaattcactaactattcacagagcaaaagagaattcatagaaagcttaaggcctaaatag

SEQ ID NO: 16632 - protein, 358 aa, Saccharomyces pastorianus
MANTTSVAVGCAVGIPIGVGIIVAVVFWFNLQKRYKEEEKNDKELERAIYDESGFVSFDNFGPLRDSKDDAGLTSAELKNPDHTSGSSEGSAHPEEKNDGKSQELEHPLAKKNSKYYVPAYRRKINLLQVRSNNYNNKAKQKSIVDLPSMNNSSNVSLSSSQQHITKRQISVYDQMVPVIADEGANFFSDPSSDNANINNVQNKPSVVELKNNARQSSNENLIKNLQNQDFGSYYPRRASSSNLNGNISNASFHTRDSSITSVNKVDALEDVFATPKSGALSQLPSTFDKNNEESDDCRSVNDDKVVTTDKDNGDLYKLQNNYDMSNIGEIAEEDQYENEFTNYSQSKREFIESLRPK

SEQ ID NO: 16633 - DNA, 1068 bp, Saccharomyces pastorianus
  CDS (1)..(1068)
atgactgccagcacatcagttgcggtgggttgtgcggtgggtatacccgtcggtgtaggtgttataatagcagtatgtttctggtttaacctacaaaaaagatacaagagggaggaacaagacgatagagaattggaaagggctatttatgatgaaagtggtttcgtgtcctttgacaattttggacccttaagagacagtaaagatgaagcagcactagccagctccgagctaaaaaatcctgatcacacttctggttcatcggaaggatctgctcatccagaagaaaaagatggaaaatcgcgagatcaagagaaaccgttagggaaaaagaatagtaaatactatgtgccagcataccgtaggaaaataaatttacttcaagtacgaaataataactacggcaataatgccaggcagaagtccgttgtggatttaccaagtataaataacagctccaatgtttccttatcatcttcccaacggcatataacaaagagacagatcagcgtttatgatcagatggtccctgttatttctgatgaaggaccaaagtttttcgcagatccttccagtgatactaatactagcaatgaccaaaacaaagcttcgatgatagaacttaaacataatactcgccaatctagtaatgaaaatctgataagaaatttgcagaatcaggactttggttcgtattacccaaggagagcttcatcctcgtttttaaatggtaacatttcaaacgcgtccttccatacaaggaattcctctataacatcggtaaataagcgcgatgccctagaggatgtgtttgcaacacccaaaagtgcggctcaatcacagttaccaaacacttttgataaagataatgaaggaatagatgctgaccactcggtaaaggatagcaggtctgcaataacagataaagataaggatatatacaaattacagaataactatgatgtgggcaatatcggggaaattgctgaggaagatcaatacgaaaacgaatttaccaactactcacagagtaagagagagttcatagaaagtctaaggcctaaatag

SEQ ID NO: 16634 - protein, 355 aa, Saccharomyces pastorianus
MTASTSVAVGCAVGIPVGVGVIIAVCFWFNLQKRYKREEQDDRELERAIYDESGFVSFDNFGPLRDSKDEAALASSELKNPDHTSGSSEGSAHPEEKDGKSRDQEKPLGKKNSKYYVPAYRRKINLLQVRNNNYGNNARQKSVVDLPSINNSSNVSLSSSQRHITKRQISVYDQMVPVISDEGPKFFADPSSDTNTSNDQNKASMIELKHNTRQSSNENLIRNLQNQDFGSYYPRRASSSFLNGNISNASFHTRNSSITSVNKRDALEDVFATPKSAAQSQLPNTFDKDNEGIDADHSVKDSRSAITDKDKDIYKLQNNYDVGNIGEIAEEDQYENEFTNYSQSKREFIESLRPK

SEQ ID NO: 16635 - DNA, 1083 bp, Candida glabrata CBS 138; identical to SEQ ID NO: 8486
  CDS (1)..(1083)

SEQ ID NO: 16636 - protein, 360 aa, Candida glabrata CBS 138; identical to SEQ ID NO: 8487

SEQ ID NO: 16637 - DNA, 1068 bp, Saccharomyces cerevisiae
  CDS (1)..(1068)
atgactgccagcacatcagttgcggtgggttgtgcggtgggtatacccgtcggtgtaggtattataatagcagtatgtttctggtttaacctacaaaaaagatacaagagggaggaacaagacgatagagaattggaaagggctatttatgatgaaagtggtttcgtgtcctttgacaattttggacccttaagagacagtaaagatgaagcagcactagccagctccgagctaaaaaatcctgatcacacttctggttcatcggaaggatctgctcatccagaagaaaaagatggaaaatcgcgagatcaagagaaaccgttagggaaaaagaatagtaaatactatgtgccagcataccgtaggaaaataaatttacttcaagtacgaaataataactacggcaataatgccaggcagaagtccgttgtggatttaccaagtataaataacagctccaatgtttccttatcatcttcccaacggcatataacaaagagacagatcagcgtttatgatcagatggtccctgttatttctgatgaaggaccaaactttttcgcagatccttccagtgatactaatactagcaatgaccaaaacaaagcttcgatgatagaacttaaacataatactcgccaatctagtaatgaaaatctgataagaaatttgcagaatcaggactttggttcgtattacccaaggagagcttcatcctcgtttttaaatggtaacatttcaaacgcgtccttccatacaaggaattcctctataacatcggtaaataagcgcgatgccctagaggatgtgtttgcaacacccaaaagtgcggctcaatcacagttaccaaacacttttgataaagataacgaaggaatggatgctgaccactcggtaaaggatagcaggtctgcaataacagataaagataaggatttatacaaattacagaataactatgatgtgggcaatatcggggaaattgctgaggaagatcaatacgaaaacgaatttaccaactactcacagagtaagagagagttcatagaaagtctaaggcctaaatag

SEQ ID NO: 16638 - protein, 355 aa, Saccharomyces cerevisiae
MTASTSVAVGCAVGIPVGVGIIIAVCFWFNLQKRYKREEQDDRELERAIYDESGFVSFDNFGPLRDSKDEAALASSELKNPDHTSGSSEGSAHPEEKDGKSRDQEKPLGKKNSKYYVPAYRRKINLLQVRNNNYGNNARQKSVVDLPSINNSSNVSLSSSQRHITKRQISVYDQMVPVISDEGPNFFADPSSDTNTSNDQNKASMIELKHNTRQSSNENLIRNLQNQDFGSYYPRRASSSFLNGNISNASFHTRNSSITSVNKRDALEDVFATPKSAAQSQLPNTFDKDNEGMDADHSVKDSRSAITDKDKDLYKLQNNYDVGNIGEIAEEDQYENEFTNYSQSKREFIESLRPK

SEQ ID NO: 16639 - DNA, 23 bp, Artificial sequence
  primer
atgactgccagcacatcagttgc

SEQ ID NO: 16640 - DNA, 25 bp, Artificial sequence
  primer
ttaaaaacgaggatgaagctctcct

SEQ ID NO: 16641 - protein, 366 aa, Artificial sequence
  consensus sequence
  Variant (3)..(4): Xaa in position 3 to 4 is any amino acid
  Variant (21)..(21): Xaa in position 21 is any amino acid
  Variant (23)..(23): Xaa in position 23 is any amino acid
  Variant (26)..(26): Xaa in position 26 is any amino acid
  Variant (37)..(37): Xaa in position 37 is any amino acid
  Variant (40)..(41): Xaa in position 40 to 41 is any amino acid
  Variant (43)..(43): Xaa in position 43 is any amino acid
  Variant (70)..(70): Xaa in position 70 is any amino acid
  Variant (72)..(72): Xaa in position 72 is any amino acid
  Variant (74)..(74): Xaa in position 74 is any amino acid
  Variant (98)..(98): Xaa in position 98 is any amino acid
  Variant (104)..(105): Xaa in position 104 to 105 is any amino acid
  Variant (107)..(107): Xaa in position 107 is any amino acid
  Variant (110)..(110): Xaa in position 110 is any amino acid
  Variant (136)..(136): Xaa in position 136 is any amino acid
  Variant (138)..(138): Xaa in position 138 is any amino acid
  Variant (140)..(140): Xaa in position 140 is any amino acid
  Variant (144)..(144): Xaa in position 144 is any amino acid
  Variant (150)..(150): Xaa in position 150 is any amino acid
  Variant (163)..(163): Xaa in position 163 is any amino acid
  Variant (181)..(181): Xaa in position 181 is any amino acid
  Variant (185)..(186): Xaa in position 185 to 186 is any amino acid
  Variant (189)..(189): Xaa in position 189 is any amino acid
  Variant (190)..(190): Xaa in position 190 is any or no amino acid
  Variant (196)..(196): Xaa in position 196 is any amino acid
  Variant (197)..(197): Xaa in position 197 is any or no amino acid
  Variant (199)..(200): Xaa in position 199 to 200 is any amino acid
  Variant (202)..(202): Xaa in position 202 is any amino acid
  Variant (206)..(206): Xaa in position 206 is any amino acid
  Variant (208)..(209): Xaa in position 208 to 209 is any amino acid
  Variant (213)..(213): Xaa in position 213 is any amino acid
  Variant (219)..(223): Xaa in position 219 to 223 is any amino acid
  Variant (230)..(230): Xaa in position 230 is any amino acid
  Variant (249)..(249): Xaa in position 249 is any amino acid
  Variant (252)..(252): Xaa in position 252 is any amino acid
  Variant (253)..(254): Xaa in position 253 to 254 is any or no amino acid
  Variant (256)..(257): Xaa in position 256 to 257 is any amino acid
  Variant (259)..(259): Xaa in position 259 is any amino acid
  Variant (263)..(263): Xaa in position 263 is any amino acid
  Variant (266)..(267): Xaa in position 266 to 267 is any amino acid
  Variant (269)..(270): Xaa in position 269 to 270 is any amino acid
  Variant (272)..(275): Xaa in position 272 to 275 is any amino acid
  Variant (277)..(277): Xaa in position 277 is any amino acid
  Variant (285)..(287): Xaa in position 285 to 287 is any amino acid
  Variant (289)..(290): Xaa in position 289 to 290 is any amino acid
  Variant (292)..(294): Xaa in position 292 to 294 is any amino acid
  Variant (296)..(297): Xaa in position 296 to 297 is any amino acid
  Variant (299)..(299): Xaa in position 299 is any amino acid
  Variant (300)..(324): Xaa in position 300 to 324 is any or no amino acid
  Variant (326)..(326): Xaa in position 326 is any amino acid
  Variant (328)..(328): Xaa in position 328 is any amino acid
  Variant (333)..(334): Xaa in position 333 to 334 is any amino acid
  Variant (336)..(337): Xaa in position 336 to 337 is any amino acid
  Variant (354)..(355): Xaa in position 354 to 355 is any amino acid
  Variant (358)..(359): Xaa in position 358 to 359 is any amino acid
  Variant (361)..(362): Xaa in position 361 to 362 is any amino acid
MTXXTSVAVGCAVGIPVGVGXIXAVXFWFNLQKRYKXEEXXDXELERAIYDESGFVSFDNFGPLRDSKDXAXLXSSELKNPDHTSGSSEGSAHPEEKXDGKSRXXEXPLXKKNSKYYVPAYRRKINLLQVRNNNYXNXAXQKSXVDLPSXNNSSNVSLSSSQXHITKRQISVYDQMVPVIXDEGXXFFXXDPSSDXXNXXNXQNKXSXXELKXNTRQSXXXXXSNENLIXNLQNQDFGSYYPRRASSSXLNXXXSXXSXHTRXSSXXSXXKXXXXEXVFATPKSXXXSXXPXXXDXXNXXXXXXXXXXXXXXXXXXXXXXXXXXYXLXNNYDXXNXXEIAEEDQYENEFTNYSXXKRXXIXXLRPK

SEQ ID NO: 16642 - protein, 55 aa, Artificial sequence
  protein pattern
  Variant (7)..(7): Xaa in position 7 is Ile or Val
  Variant (11)..(11): Xaa in position 11 is any or no amino acid
  Variant (14)..(14): Xaa in position 14 is any or no amino acid
  Variant (17)..(17): Xaa in position 17 is Cys or Val
  Variant (28)..(28): Xaa in position 28 is Glu or Arg
  Variant (31)..(31): Xaa in position 31 is any amino acid
  Variant (32)..(32): Xaa in position 32 is any or no amino acid
  Variant (34)..(34): Xaa in position 34 is Asp, Lys or Arg
CAVGIPXGVGXIIXAVXFWFNLQKRYKXEEXXDXELERAIYDESGFVSFDNFGPL

SEQ ID NO: 16643 - protein, 40 aa, Artificial sequence
  protein pattern
  Variant (2)..(2): Xaa in position 2 is Met or Val
  Variant (3)..(3): Xaa in position 3 is Ile or Val
  Variant (7)..(7): Xaa in position 7 is any amino acid
  Variant (9)..(9): Xaa in position 9 is Ala or Thr
  Variant (19)..(19): Xaa in position 19 is Lys or Arg
  Variant (38)..(38): Xaa in position 38 is any amino acid
  Variant (40)..(40): Xaa in position 40 is Asn or Thr
SXXELKXNXRQSSNENLIXNLQNQDFGSYYPRRASSSXLX

SEQ ID NO: 16644 - protein, 29 aa, Artificial sequence
  protein pattern
  Variant (2)..(2): Xaa in position 2 is any amino acid
  Variant (20)..(20): Xaa in position 20 is Ala or Ser
  Variant (24)..(24): Xaa in position 24 is Ala or Pro
  Variant (25)..(25): Xaa in position 25 is any amino acid
  Variant (28)..(28): Xaa in position 28 is Ala or Ser
QXHITKRQISVYDQMVPVIXDEGXXFFXD

SEQ ID NO: 16645 - protein, 21 aa, Artificial sequence
  protein pattern
  Variant (3)..(3): Xaa in position 3 is Ala or Gly
PLXKKNSKYYVPAYRRKINLL

SEQ ID NO: 16646 - protein, 29 aa, Artificial sequence
  protein pattern
  Variant (2)..(2): Xaa in position 2 is Ala, Gly or Leu
  Variant (4)..(4): Xaa in position 4 is Ala or Thr
  Variant (6)..(6): Xaa in position 6 is any or no amino acid
  Variant (28)..(28): Xaa in position 28 is any or no amino acid
AXLXSXELKNPDHTSGSSEGSAHPEEKXD

SEQ ID NO: 16647 - DNA, 1377 bp, Saccharomyces cerevisiae
  CDS (1)..(1377)
atgatcacccagcctgctaagtgccctctattgatccgtatatcagcttttagatcaggctcgagtttcttgttatatgtgcattgcaaaagcataaacaaatcctggcagccgaagccgggcaatccacttcgaaacgcacggctgaactatataaatataaaggacatgtggagagaagcttctcttccttcacatttcgcatttcatgatctaaagtggttctttcacaatagaagagcaccaacacgaaatatggctgtcggtggtaataactggagcatgtggctgcgaatgtcacgggtccacctcaggcagatcacgaagtctctggaccgaacgctgatcagtttgagccatgggaatttttcccaccaatataatcgcaatatttttgtcacttggtggaagagcctatttgtggcttctacagcttttaggagggcaagtggtttaacggtatctcctctcacgaggagaggaatcgcaaggtttgaccatttcagacctgttcccaatgtcagtaaatttgcttcttttcccagagtgcccaaaggagccccaaggggcctttttaccaactggaatatgactacatcaaagagattattagggcagagagcttattcgacttccagtatcaaatttacccaagaagccgtgaataacatgactatatctttgaggtgttttttcaactcactaggcggattaaatcagtgctcccactctaattcctgcaaagcttatcagaatgcgtctaatgttacctctaaacaggatcacgtccaaccagttgcccttaagaagttatctcaaaaggatatcaatttcattcgtaatttagaactatttaagataatgaagacccagaatgaagtcgttgatgaaacaagcgcatattacatggaaaaaccaggttcctatattgaatttaccatttcagaatttaacgttaatgggacattctccgcacctttgtcatttttagatccttctttgttagcggatttggatgaaatgattagaaattacaaatacgaattaaaatcaatatacagtagtgttgacatgatcttgcagaattatggatcattgccgataacttttcatcgaaataagattcgaatacattttccaaactcaactgtggtggaaacggaaaaactaattgcaggtctgaatattgctacgggtgttatttacgcagatacgtctcccgatatcagtctagaaggtacaaatttgaatgctctggttaatgttgacaattcaggaagcgtatggtcttttgttaaggagccctcgtttccctctaggagcgctttttcacctattttatcagatgcatcctatgatacttatgaattggtctag

SEQ ID NO: 16648 - protein, 458 aa, Saccharomyces cerevisiae
MITQPAKCPLLIRISAFRSGSSFLLYVHCKSINKSWQPKPGNPLRNARLNYINIKDMWREASLPSHFAFHDLKWFFHNRRAPTRNMAVGGNNWSMWLRMSRVHLRQITKSLDRTLISLSHGNFSHQYNRNIFVTWWKSLFVASTAFRRASGLTVSPLTRRGIARFDHFRPVPNVSKFASFPRVPKGAPRGLFTNWNMTTSKRLLGQRAYSTSSIKFTQEAVNNMTISLRCFFNSLGGLNQCSHSNSCKAYQNASNVTSKQDHVQPVALKKLSQKDINFIRNLELFKIMKTQNEVVDETSAYYMEKPGSYIEFTISEFNVNGTFSAPLSFLDPSLLADLDEMIRNYKYELKSIYSSVDMILQNYGSLPITFHRNKIRIHFPNSTVVETEKLIAGLNIATGVIYADTSPDISLEGTNLNALVNVDNSGSVWSFVKEPSFPSRSAFSPILSDASYDTYELV

SEQ ID NO: 16649 - DNA, 1122 bp, Saccharomyces cerevisiae; identical to SEQ ID NO: 12416
  CDS (1)..(1122)

SEQ ID NO: 16650 - protein, 373 aa, Saccharomyces cerevisiae; identical to SEQ ID NO: 12417

SEQ ID NO: 16651 - DNA, 1377 bp, Saccharomyces cerevisiae; identical to SEQ ID NO: 12414
  CDS (1)..(1377)

SEQ ID NO: 16652 - protein, 458 aa, Saccharomyces cerevisiae; identical to SEQ ID NO: 12415

SEQ ID NO: 16653 - DNA, 23 bp, Artificial sequence
  primer
atgatcacccagcctgctaagtg

SEQ ID NO: 16654 - DNA, 26 bp, Artificial sequence
  primer
ctagaccaattcataagtatcatagg

SEQ ID NO: 16655 - DNA, 645 bp, Escherichia coli; identical to SEQ ID NO: 812
  CDS (1)..(645): transl_table=11

SEQ ID NO: 16656 - protein, 214 aa, Escherichia coli; identical to SEQ ID NO: 813

SEQ ID NO: 16657 - DNA, 732 bp, Triticum aestivum
  CDS (1)..(732)
atgctgaggcggcggctgagctcccttctcctccgatccccgtgctcctccgccgtcgcttcctcctgccaccaccagcagcaccacctcctcctccccacccacgccgagaaaccgccggccccgaatctgctcaggctcttcacgtccctagctggaagcgatggtgacaggccgttcatcgctttcgtcttagggggacctgggagtgggaaaggaacgcaatgtagtaggatcgcttcggattttggattttctcatgtgagtgctggtgaccttctgcgcaatgaaatatcttcgggcactgatcatggggagtggatcctagagataataagggaagggaggattgttccatcagagataactgttgagcttgtcagaaaagcaattgaatcaagctctgctaaaagggttcttattgatggtttcccaaggtgtgaggaaaacagaattgcctttgaaaaaataactggaactgaaccagaccttgtgcttttctttgactgtcctgaggatgagatggttaaacgtctcctaagccgtaaccagggacgagttgatgataacattgagacaatcaagaagcgtctaaaagtgttcgagagtttgaatcttcctgttgttgagtactactcttcaaggggaaaggcacacaagataaacgcaacgggaactgaagatgaaatctttgaagcagttcgcaagttgttttccaccttaaggctatga

SEQ ID NO: 16658 - protein, 243 aa, Triticum aestivum
MLRRRLSSLLLRSPCSSAVASSCHHQQHHLLLPTHAEKPPAPNLLRLFTSLAGSDGDRPFIAFVLGGPGSGKGTQCSRIASDFGFSHVSAGDLLRNEISSGTDHGEWILEIIREGRIVPSEITVELVRKAIESSSAKRVLIDGFPRCEENRIAFEKITGTEPDLVLFFDCPEDEMVKRLLSRNQGRVDDNIETIKKRLKVFESLNLPVVEYYSSRGKAHKINATGTEDEIFEAVRKLFSTLRL

SEQ ID NO: 16659 - DNA, 660 bp, Escherichia coli; identical to SEQ ID NO: 1975
  CDS (1)..(660): transl_table=11

SEQ ID NO: 16660 - protein, 219 aa, Escherichia coli; identical to SEQ ID NO: 1976

SEQ ID NO: 16661 - DNA, 687 bp, Triticum aestivum
  CDS (1)..(687)
atggcagcagcggcggcgcagaggcttcttgcgtcgagcacgaagatcgtcggggccgggcgcaactacatctcccatgccaaggatctcggcaaccctgtcctcaaggaacccgtcctgttcctgaagcccacgtcgtcattcctccacgccggcccgaccgccggccccatcgaggtgcccgagccgctcgagtcgctgcaccacgaggtcgaactcgccgtcgtcatctcccggcgcgcgcgcgatgtccccgaggcctccgccatggatttcgtcggaggttatgcacttgctttggacatgtcatcaaacgatctgcaatcagcttctaagtctgcaggtcttccttggactttgggtaaagtacaggacacctttactccaattagtgcggtggttccgaaatctgcaatcgctaatccctatgacctagaactgtggctaaaggtagatggtgaacttaggcagaagggacttacaagtgatatgatattcaagattccttttctaatcagttatatcagttccatcatgacattaatggagggcgatgtgatattaactggtactcctcccgatggcgttggtcctgtccgagtgggacagaagattaatgctggtataactgacctcattgatgtagagtttgatgttgagagacgcaaacgttcattttcttactga

SEQ ID NO: 16662 - protein, 228 aa, Triticum aestivum
MAAAAAQRLLASSTKIVGAGRNYISHAKDLGNPVLKEPVLFLKPTSSFLHAGPTAGPIEVPEPLESLHHEVELAVVISRRARDVPEASAMDFVGGYALALDMSSNDLQSASKSAGLPWTLGKVQDTFTPISAVVPKSAIANPYDLELWLKVDGELRQKGLTSDMIFKIPFLISYISSIMTLMEGDVILTGTPPDGVGPVRVGQKINAGITDLIDVEFDVERRKRSFSY

SEQ ID NO: 16663 - DNA, 1755 bp, Saccharomyces cerevisiae; identical to SEQ ID NO: 4506
  CDS (1)..(1755)

SEQ ID NO: 16664 - protein, 584 aa, Saccharomyces cerevisiae; identical to SEQ ID NO: 4507

SEQ ID NO: 16665 - DNA, 1536 bp, Glycine max
  CDS (1)..(1536)
atggcaggaggagcttatgtagattcgggaaatgcaaagcaatttgatgggaaggtcacggcattcgtattggttacatgctttgtggcagccatgggaggcttactcttcggttatgatcttggaataaccggaggagtgacttctatggaaccatttctcatcaaattctttcccggtgtttataaacaaatgcaagatgatgttggccatagaagccaatattgcaaatttgacaacgagctccttacactcttcacctcttccttgtatcttgctgcattagtagcttctttctttgcttccaccactacaaggatgatgggacgcaaggcctccatgttcttaggaggcttgtttttccttgtgggggcattattaaacggcttcgccgtcaacattgaaatgctgatcataggccgcctcttgcttggtttcggtgtcggatactgtaatcagtccgttccggtgtatttgtccgaaatggctcctgcaaagattagaggagcacttaacatgggcttccaaatgatgatcacaattggcatcttaattgcaaatcttatcaactatggaacttccaaactagaaaacggatggagaatttctttgggtgtcggagctgttcctgccgtcttgttatgttttggagctcttttcttaggagacacacctaattccctgattgaaagaggtcaaaaggaagaagccaggaaaatgttgcaaaaaatccgtggcattgataatgttgaagaggagctacaagagcttgttcttgcaagtgagtcagctaaagaggtggagcacccatggaagaacattacaacgccaaaatacaggcctcagctcactttttgcaccttgattccatttttccaacaactcactggcattaacgttgtcatgttctatgcccctgtccttttcaagactttgggctttggcaacgatgcttcccttatgtcttcagttatcaccggaggtgtaaatgtggttgccactcttgtttccatcttgactgtggacaaggttggaagaaaagttttattccttgaaggtggtgttcaaatgttgatttgccagattgctactggagtcatgattgctatgaagttcggggtgagtggcgaaggctcgttttcctccggagaagccaaccttattttgttctttatatgtgcatttgttgctgcatttgcatggtcttggggtccactagggtggttggtgcctagtgaaatatgccctcttgaggttcgttcagcaggtcaagccatcaatgttgccgtaaacatgctgttcacttttgcgattgctcaagttttcctagtcatgctttgccacttgaagtttggccttttcttcttctttgctgcatttgtactcatcatgaccatcttcattgccatgttgttgcctgagacaaagaacatccccattgaagaaatgcatacagtctggagatcacattggttttggtcaaagattgttccacatgctgatgatgatcgcaagcctgaggctgcccaaagttga

SEQ ID NO: 16666 - protein, 511 aa, Glycine max
MAGGAYVDSGNAKQFDGKVTAFVLVTCFVAAMGGLLFGYDLGITGGVTSMEPFLIKFFPGVYKQMQDDVGHRSQYCKFDNELLTLFTSSLYLAALVASFFASTTTRMMGRKASMFLGGLFFLVGALLNGFAVNIEMLIIGRLLLGFGVGYCNQSVPVYLSEMAPAKIRGALNMGFQMMITIGILIANLINYGTSKLENGWRISLGVGAVPAVLLCFGALFLGDTPNSLIERGQKEEARKMLQKIRGIDNVEEELQELVLASESAKEVEHPWKNITTPKYRPQLTFCTLIPFFQQLTGINVVMFYAPVLFKTLGFGNDASLMSSVITGGVNVVATLVSILTVDKVGRKVLFLEGGVQMLICQIATGVMIAMKFGVSGEGSFSSGEANLILFFICAFVAAFAWSWGPLGWLVPSEICPLEVRSAGQAINVAVNMLFTFAIAQVFLVMLCHLKFGLFFFFAAFVLIMTIFIAMLLPETKNIPIEEMHTVWRSHWFWSKIVPHADDDRKPEAAQS

SEQ ID NO: 16667 - DNA, 1341 bp, Saccharomyces cerevisiae; identical to SEQ ID NO: 5812
  CDS (1)..(1341)

SEQ ID NO: 16668 - protein, 446 aa, Saccharomyces cerevisiae; identical to SEQ ID NO: 5813

SEQ ID NO: 16669 - DNA, 1326 bp, Linum usitatissimum
  CDS (1)..(1326)
atgttggacattaatctgttcagggaggataagggaagcaatccggaaatcacccgcgaatctcagcgtcgtcgttcggccaatgttgggattgttgatgagattattaagcttgacaaggaatggaggcaacgtcaattcgagtatgacaatctgaggaaggattttaacaagatcaacaaacaagttgccaaactcaggatcagtggtggagatgcaactgaacttatccagagcactgatgataacaagaagcaaactgcattgaaagagattgaggtgcaggaggctaagtcatctttgtatgcaaagttgcaaacagttggtaaccttgtccatgattccgtccctatcagcaaagacgaggcaaataacgaagtaatcagagtttggggggagaaacgcactgacaagaaactcaagagtcatgttgaccttattgaacttcttggaatcgctgatgtgaagaaaggggctgatgtagctggaagcagaggctactacctaaaaggtgacggtgtactactcaatcaagcgttgataaattacggacttactttcttaaggaaaagagggttcactcccctgcagactccctttttcatgagaaaggatatcatgggccagtgtgctcagttgcaacagtttgacgacgaactttataaggtgaccggagagggggatgataaatatttaattgctacggctgaacaaccactatgtgcgtatcacctagatgagtggattcatccctctgaactaccgaccagatatgctggatactcaacctgtttccgcaaagaagctggttcgcatggtcgggacactttaggaattttccgagttcatcagtttgagaaactggagcagttctgcattacaagcccaaatgacaatgcctcgtgggttatgcttgaagaaatgatgaagaattctgaagaattttaccagacgctgaacctaccttatcaagttatctccatcgtttcgggggccttgaatgatgctgctgcaaagaagtatgatcttgaggcatggtttcctggttcaaatgcctacagggagttagtctcctgttcaaattgcaccgattacaagtcgagaagattggaaacccgatatgggcagaaaaagagcaatgaggcagcaaagcaatatgttcacatgttgaactcgaccctgacggctacggaaaggacaatgtgctgcatactcgaaaactaccagagggaagatggagttgagatcccagaagttttgagaccatacatggctgatgtaaccttcatgcctttcctcgcaggaaagggaaagaaagccaagtag

SEQ ID NO: 16670 - protein, 441 aa, Linum usitatissimum
MLDINLFREDKGSNPEITRESQRRRSANVGIVDEIIKLDKEWRQRQFEYDNLRKDFNKINKQVAKLRISGGDATELIQSTDDNKKQTALKEIEVQEAKSSLYAKLQTVGNLVHDSVPISKDEANNEVIRVWGEKRTDKKLKSHVDLIELLGIADVKKGADVAGSRGYYLKGDGVLLNQALINYGLTFLRKRGFTPLQTPFFMRKDIMGQCAQLQQFDDELYKVTGEGDDKYLIATAEQPLCAYHLDEWIHPSELPTRYAGYSTCFRKEAGSHGRDTLGIFRVHQFEKLEQFCITSPNDNASWVMLEEMMKNSEEFYQTLNLPYQVISIVSGALNDAAAKKYDLEAWFPGSNAYRELVSCSNCTDYKSRRLETRYGQKKSNEAAKQYVHMLNSTLTATERTMCCILENYQREDGVEIPEVLRPYMADVTFMPFLAGKGKKAK

SEQ ID NO: 16671 - DNA, 444 bp, Saccharomyces cerevisiae; identical to SEQ ID NO: 6550
  CDS (1)..(444)

SEQ ID NO: 16672 - protein, 147 aa, Saccharomyces cerevisiae; identical to SEQ ID NO: 6551

SEQ ID NO: 16673 - DNA, 429 bp, Linum usitatissimum
  CDS (1)..(429)
atgatccggttcatacttctgcagaacaggcaaggaaagactcgtctcgccaagtactatgtacctctcgaggatactgaaaaacacagagtagagtacgaggttcatcgactggttgtcaatcgagatcccaagttcacgaatttcgttgagttcagaacacacaaggtcatctaccgacggtatgctggactgttcttctccctatgcgtggacataacagataacgaattggcttacttggagtgcatccatttgtttgtggagatattggatcatttcttcagcaacgtgtgtgagctagacttggtgtttaacttccacaaggtttacctgatacttgatgagttcattcttgctggagagctccaagaaacaagcaaaagagcgattatagagagaatgggagaactagagaagctggagtaa

SEQ ID NO: 16674 - protein, 142 aa, Linum usitatissimum
MIRFILLQNRQGKTRLAKYYVPLEDTEKHRVEYEVHRLVVNRDPKFTNFVEFRTHKVIYRRYAGLFFSLCVDITDNELAYLECIHLFVEILDHFFSNVCELDLVFNFHKVYLILDEFILAGELQETSKRAIIERMGELEKLE

SEQ ID NO: 16675 - DNA, 429 bp, Hordeum vulgare
  CDS (1)..(429)
atgatccgtttcatactattacagaaccggcaggggaagacgcggcttgccaagtactacgtcccgctcgaggactcggagaagcacaaggttgagtatgaggtgcatcggctggtcgtcaacagggatcccaagttcactaacttcgttgagttccgtacgcacaaagttatctacaggagatatgcaggactatttttctcaatatgtgtagatatcacggataatgagttggtatatttggaatgtatccacttatttgtggagatattggaccatttcttcagcaacgtgtgtgaacttgatttagtatttaacttccacaaggtttacttgatattggatgagtttattctcgccggagagctgcaagaaacaagcaaaaaggcgattatagagagaatgggtgaacttgagaagctggattaa

SEQ ID NO: 16676 - protein, 142 aa, Hordeum vulgare
MIRFILLQNRQGKTRLAKYYVPLEDSEKHKVEYEVHRLVVNRDPKFTNFVEFRTHKVIYRRYAGLFFSICVDITDNELVYLECIHLFVEILDHFFSNVCELDLVFNFHKVYLILDEFILAGELQETSKKAIIERMGELEKLD

SEQ ID NO: 16677 - DNA, 786 bp, Saccharomyces cerevisiae; identical to SEQ ID NO: 7475
  CDS (1)..(786)

SEQ ID NO: 16678 - protein, 261 aa, Saccharomyces cerevisiae; identical to SEQ ID NO: 7476

SEQ ID NO: 16679 - DNA, 789 bp, Helianthus annuus
  CDS (1)..(789)
atggctagaggactaaagaagcatatgaagaggctcaatgctcccaagcattggatgcttgacaaacttggtggcgctttcgctcctaagccatcatctgggccgcataaatctagggaatgcttgccgttgatcctcatactgaggaaccggttgaagtatgccttgacttaccgtgaggttcaatctattttgatgcaacgacatgttcttgttgacaacaaggtcaggactgacaagacgtaccctgctggtttcatggatgttgtttctattcccaagaccaatgaaagcttccgtcttctttatgacacaaagggtagatttagactgcactcaatcagagacgaggagtcaaagtttaaattgtgcaaggttcgttcagttcagtttggttcaaagggaattccatacatcaacacctatgatggtcgaaccattcgttaccccgacccactcatcaaagctaatgacaccatcaagcttgatctagaatcaaacaagattgttgatttcatcaaatttgatgttggtaatgttgttatggtaactggtggaagaaacactggccgggttggaatccttaagaaccgggaaaaacataagggcagcttcgaaactgttcacattcaagatgcaaccggccatgagtttgcgacccgtttgggtaatgtttttacccttggaaagggttcaaaaccgtgggtttccttacctaagggtaagggtatcaagctaaccatcatcgaagaggctagaaagaggcaggctgctcaagaagccgcttag

SEQ ID NO: 16680 - protein, 262 aa, Helianthus annuus
MARGLKKHMKRLNAPKHWMLDKLGGAFAPKPSSGPHKSRECLPLILILRNRLKYALTYREVQSILMQRHVLVDNKVRTDKTYPAGFMDVVSIPKTNESFRLLYDTKGRFRLHSIRDEESKFKLCKVRSVQFGSKGIPYINTYDGRTIRYPDPLIKANDTIKLDLESNKIVDFIKFDVGNVVMVTGGRNTGRVGILKNREKHKGSFETVHIQDATGHEFATRLGNVFTLGKGSKPWVSLPKGKGIKLTIIEEARKRQAAQEAA
